US007138501B2

(12) United States Patent
Ruben et al.

(10) Patent No.: US 7,138,501 B2
(45) Date of Patent: Nov. 21, 2006

(54) ANTIBODIES THAT IMMUNOSPECIFICALLY BIND BLYS

(75) Inventors: Steven M. Ruben, Olney, MD (US); Gil H. Choi, Rockville, MD (US); Tristan Vaughan, Great Shelford (GB); David Hilbert, Bethesda, MD (US)

(73) Assignee: Human Genome Sciences, Inc., Rockville, MD (US)

( * ) Notice: Subject to any disclaimer, the term of this patent is extended or adjusted under 35 U.S.C. 154(b) by 754 days.

(21) Appl. No.: 09/880,748

(22) Filed: Jun. 15, 2001

(65) Prior Publication Data

US 2003/0059937 A1 Mar. 27, 2003

Related U.S. Application Data

(60) Provisional application No. 60/293,499, filed on May 25, 2001, provisional application No. 60/277,379, filed on Mar. 21, 2001, provisional application No. 60/276,248, filed on Mar. 16, 2001, provisional application No. 60/240,816, filed on Oct. 17, 2000, provisional application No. 60/212,210, filed on Jun. 16, 2000.

(51) Int. Cl.
*C07K 16/00* (2006.01)
*C12P 21/08* (2006.01)

(52) U.S. Cl. ............................ 530/388.23; 530/387.1; 530/387.3; 530/387.9; 530/388.15; 530/391.1; 530/391.3; 530/391.7

(58) Field of Classification Search ............ 530/387.1, 530/387.3, 387.9, 388.1, 388.15, 388.23, 530/389.1, 389.2, 391.1, 391.3, 391.7; 435/326, 435/328, 331, 335

See application file for complete search history.

(56) References Cited

U.S. PATENT DOCUMENTS

| | | | |
|---|---|---|---|
| 6,297,367 | B1 | 10/2001 | Tribouley |
| 6,403,770 | B1 | 6/2002 | Yu et al. |
| 6,562,579 | B1 | 5/2003 | Yu et al. |
| 2001/0010925 | A1 | 8/2001 | Wiley |
| 2002/0055624 | A1 | 5/2002 | WIley |
| 2003/0012783 | A1 | 1/2003 | Kindsvogel |

FOREIGN PATENT DOCUMENTS

| | | | |
|---|---|---|---|
| EP | 0869180 | A1 | 10/1998 |
| EP | 0921194 | A2 | 6/1999 |
| WO | WO97/33902 | A1 | 9/1997 |
| WO | WO98/18921 | A1 | 5/1998 |
| WO | WO98/27114 | A2 | 6/1998 |
| WO | WO98/55620 | A1 | 12/1998 |
| WO | WO98/55621 | A1 | 12/1998 |
| WO | WO99/11791 | A2 | 3/1999 |
| WO | WO99/12964 | A2 | 3/1999 |
| WO | WO99/33980 | A2 | 7/1999 |
| WO | WO00/26244 | A2 | 5/2000 |
| WO | WO00/39295 | A1 | 7/2000 |
| WO | WO00/40716 | A2 | 7/2000 |
| WO | WO00/43032 | A2 | 7/2000 |
| WO | WO00/45836 | A1 | 8/2000 |
| WO | WO00/47740 | A2 | 8/2000 |
| WO | WO00/50597 | A2 | 8/2000 |
| WO | WO00/60079 | A2 | 10/2000 |
| WO | WO00/67034 | A1 | 11/2000 |
| WO | WO00/68378 | A1 | 11/2000 |
| WO | WO00/77256 | A1 | 12/2000 |
| WO | WO01/40466 | A2 | 6/2001 |
| WO | WO01/87977 | A2 | 11/2001 |

OTHER PUBLICATIONS

Kennell, D.E., Prog. Nucl. Acid Res. Med. Biol, 11:259-301 1971.*

Kabat et al Sequences of Proteins of Immunological Interest Forth Edition, 1987, pp. 44, 53, 54, 63, 69, 70, and 76.*

Ashkenazi, et al., Response, Nature Immunology, (2000) 1:179.

Baumgarth, Nicole, Secreted IgM versus BLyS in Germinal Center Formation, Nature Immunology, (2000) 1:179.

Batten et al., BFF Mediates Survival of Peripheral Immature B Lymphocytes. The Journal of Experimental Medicine, (2000) 192:1453-65.

Cheema et al., Elevated Serum B Lymphocyte Stimulator Levels in Patients with Systemic Immune-Based Rheumatic Diseases, Arthritis and Rheumatism (2001) 44:1313-1319.

Cyster, Jason G., B Cells on the Front Line, Nature Immunology, (2000) 1:9-10.

Do et al., Attenuation of Apoptosis Underlies B Lymphocyte Stimulator Enhancement of Humoral Immune Response, The Journal of Experimental Medicine, (2000) 192: 953-964.

Dorner and Putterman, B cells, BAFF/zTNF4, TACI, and Systemic Lupus Erythematosus, Arthritis Research (2001) 3:197-9.

(Continued)

*Primary Examiner*—Patricia A. Duffy
(74) *Attorney, Agent, or Firm*—Human Genome Sciences, Inc.

(57) ABSTRACT

The present invention relates to antibodies and related molecules that immunospecifically bind to B Lymphocyte Stimulator. The present invention also relates to methods and compositions for detecting or diagnosing a disease or disorder associated with aberrant B Lymphocyte Stimulator expression or inappropriate function of B Lymphocyte Stimulator comprising antibodies or fragments or variants thereof or related molecules that immunospecifically bind to B Lymphocyte Stimulator. The present invention further relates to methods and compositions for preventing, treating or ameliorating a disease or disorder associated with aberrant B Lymphocyte Stimulator expression or inappropriate B Lymphocyte Stimulator function comprising administering to an animal an effective amount of one or more antibodies or fragments or variants thereof or related molecules that immunospecifically bind to B Lymphocyte Stimulator.

37 Claims, 16 Drawing Sheets

OTHER PUBLICATIONS

Gross et al., TACI and BCMA are receptors for a TNF Homologue Implicated in B-Cell Autoimmune Disease, Nature, (2000) 404:995-999.
Hatzoglou et al., TNF Receptor Family Member BCMA (B Cell Maturation) Associates with TNF Receptor-Associated Factor (TRAF) 1, TRAF2, TRAF3 and Activates NF-kB, Elk-1, c-Jun N-Terminal Kinase, and p38 Mitogen-Activated Protein Kinase, The Journal of Immunology, (2000) 165:1322-1330.
Hu et al., Characterization of TNFRSF19, a Novel Member of the Tumor Necrosis Factor Receptor Superfamily, Genomics, 62:1023-107 (1999).
Khare et al., Severe B Cell Hyperplasia and autoimmune disease in TALL-1 transgenic mice, The Proceedings of the National Academy of Sciences, (2000) 97:3370-3375.
Laabi et al., Lymphocyte Survival-Ignorance is BLyS, Science, (2001) 289-883.
Mackay et al., Mice Transgenic for BAFF Develop Lymphocytic Disorders Along with Autoimmune Manifestations, The Journal of Experimental Medicine, (1999) 190:1697-1710.
Marsters, et al., Interaction of the TNF Homologues BLyS and APRIL. with the TNF Receptor Homologues BCMA and TACI Current Biology, (2000) 10:785-788.
Moore et al., BLyS: Member of the Tumor Necrosis Factor Family and B Lymphocyte Stimulator, Science, (1999) 285:260-263.
Mukhopadhay et al., Identification and Characterization of a Novel Cytokine, THANK, A TNF Homologue That Activates Apoptosis, Nuclear Factor-KB, c-Jun NH2 Terminal Kinase (1999) The Journal of Biological Chemistry 274:15978-81.
Nardelli et al., Synthesis and Release of B-lymphocyte Stimulator from Myeloid Cells, Blood, (2001) 97:198-204.
Parry et al., Pharmacokinetics and Immunological Effects of Exogenously Administered Recombinant Human B Lymphocyte Stimulator (BLyS) in Mice, The Journal of Pharmacology and Experimental Therapeutics, (2001) 296:396-404.
Schneider et al., BAFF, a Novel Ligand of the Tumor Necrosis Factor Family, Stimulates B Cell Growth, The Journal of Experimental Medicine, (1999) 189:1747-1756.
Shu et al., TALL-1 is a Novel Memeber of the TNF Family that is Down-Regulated by Mitogens, Journal of Leukocyte Biology, (1999) 65:680-683.
Thompson et al., BAFF Binds to the Tumor Necrosis Factor Receptor-like Molecule B Cell Maturation Antigen and Is Important for Maintaining the Peripheral B Cell Population, The Journal of Experimental Medicine, (2000) 192:129-135.
Tribouley et al, Characterization of a New Member of the TNF Family Expressed on Antigen Presenting Cells, (1999) Biological Chemistry 380:1443-7.
Ware, Carl, APRIL and BAFF Connect Autoimmunity and Cancer. The Journal of Experimental Medicine (2000) 192:F35-F37.
Xia et al., TACI Is a TRAF-interacting Receptor for TALL-1, a Tumor Necrosis Factor Family Member Involved in B Cell Regulation, The Journal of Experimental Medicine, (2000) 192:137-143.
Yan et al., Identification of a receptor for BLyS Demonstrates a Crucial Role in Humoral Immunity, Nature Immunology, (2000) 1:37-41.
Yu et al., APRIL and TALL-1 and Receptors BCMA and TACI: System for Regulating Humoral Immunity, Nature Immunology, (2000) 1:252-256.
Zhang et al., Cutting Edge: A Role for B Lymphocyte Stimulator in Systemic Lupus Erythematosus, The Journal of Immunology, (2001) 166:6-10.
Kanakaraj et al., BLyS Binds to B Cells With High Affinity and Induces Activation of the Transcription Factors NF-kB and Elf-1, Cytokine (2001) 13:25-31.
Wu et al., Tumor Necrosis Factor (TNF) Receptor Superfamily Member TACI Is a High Affinity Receptor for TNF Family Members APRIL and BLyS, The Journal of Biological Chemistry (2000) 275:35478-35485.

* cited by examiner

Scfvs to soluble BLyS only

Plate I079 Sensorgram - 8 Clones

ANTIBODIES THAT IMMUNOSPECIFICALLY BIND BLYS

INTRODUCTION

The present invention relates to antibodies and related molecules that immunospecifically bind to B Lymphocyte Stimulator (BLyS™) protein. The present invention also relates to methods and compositions for detecting, diagnosing, or prognosing a disease or disorder associated with aberrant B Lymphocyte Stimulator or B Lymphocyte Stimulator receptor expression or inappropriate function of B Lymphocyte Stimulator or B Lymphocyte Stimulator receptor, comprising antibodies or fragments or variants thereof, or related molecules, that immunospecifically bind to B Lymphocyte Stimulator. The present invention further relates to methods and compositions for preventing, treating or ameliorating a disease or disorder associated with aberrant B Lymphocyte Stimulator or B Lymphocyte Stimulator receptor expression or inappropriate B Lymphocyte Stimulator function or B Lymphocyte Stimulator receptor function, comprising administering to an animal, preferably a human, an effective amount of one or more antibodies or fragments or variants thereof, or related molecules, that immunospecifically bind to B Lymphocyte Stimulator.

BACKGROUND OF THE INVENTION

B Lymphocyte Stimulator (BLyS™) protein is a member of the tumor necrosis factor ("TNF") superfamily that induces both in vivo and in vitro B cell proliferation and differentiation (Moore et al., Science 285: 260–263 (1999)). B Lymphocyte Stimulator is distinguishable from other B cell growth and differentiation factors such as IL-2, IL-4, IL-5, IL-6, IL-7, IL-13, IL-15, CD40L, or CD27L (CD70) by its monocyte-specific gene and protein expression pattern and its specific receptor distribution and biological activity on B lymphocytes. B Lymphocyte Stimulator expression is not detected on natural killer ("NK") cells, T cells or B cells, but is restricted to cells of myeloid origin. B Lymphocyte Stimulator expression on resting monocytes is upregulated by interferon-gamma (IFN-gamma). The gene encoding B Lymphocyte Stimulator has been mapped to chromosome 13q34.

B Lymphocyte Stimulator is expressed as a 285 amino acid type II membrane-bound polypeptide and a soluble 152 amino acid polypeptide (Moore et al., 1999 supra). The membrane-bound form of B Lymphocyte Stimulator has a predicted transmembrane spanning domain between amino acid residues 47 and 73. The $NH_2$-terminus of the soluble form of B Lymphocyte Stimulator begins at $Ala^{134}$ of the membrane-bound form of B Lymphocyte Stimulator. Soluble recombinant B Lymphocyte Stimulator has been shown to induce in vitro proliferation of murine splenic B cells and to bind to a cell-surface receptor on these cells (Moore et al., 1999 supra). Soluble B Lymphocyte Stimulator administration to mice has been shown to result in an increase in the proportion of $CD45R^{dull}$, $Ly6D^{bright}$ (also known as ThB) B cells and an increase in serum IgM and IgA levels (Moore et al., 1999 supra). Thus, B Lymphocyte Stimulator displays a B cell tropism in both its receptor distribution and biological activity.

Based upon its expression pattern and biological activity, B Lymphocyte Stimulator has been suggested to be involved in the exchange of signals between B cells and monocytes or their differentiated progeny. The restricted expression patterns of B Lymphocyte Stimulator receptor and ligand suggest that B Lymphocyte Stimulator may function as a regulator of T cell-independent responses in a manner analogous to that of CD40 and CD40L in T cell-dependent antigen activation. As such, antibodies and related molecules that immunospecifically bind to B Lymphocyte Stimulator may find medical utility in, for example, the treatment of B cell disorders associated with autoimmunity, neoplasia, or immunodeficiency syndromes.

SUMMARY OF THE INVENTION

The present invention encompasses antibodies (including molecules comprising, or alternatively consisting of, antibody fragments or variants thereof) that immunospecifically bind to a polypeptide or polypeptide fragment of B Lymphocyte Stimulator. In particular, the invention encompasses antibodies (including molecules comprising, or alternatively consisting of, antibody fragments or variants thereof) that immunospecifically bind to a polypeptide or polypeptide fragment of human B Lymphocyte Stimulator (SEQ ID NOS:3228 and/or 3229) or B Lymphocyte Stimulator expressed on human monocytes; murine B Lymphocyte Stimulator (SEQ ID NOS:3230 and/or 3231) or B Lymphocyte Stimulator expressed on murine monocytes; rat B Lymphocyte Stimulator (either the soluble forms as given in SEQ ID NOS:3232, 3233, 3234 and/or 3235 or in a membrane associated form, e.g., on the surface of rat monocytes); or monkey B Lymphocyte Stimulator (e.g., the monkey B Lymphocyte Stimulator polypeptides of SEQ ID NOS:3236 and/or 3237, the soluble form of monkey B Lymphocyte Stimulator, or B Lymphocyte Stimulator expressed on monkey monocytes), preferably human B Lymphocyte Stimulator. The present invention also encompasses methods and compositions for detecting, diagnosing, or prognosing diseases or disorders associated with aberrant B Lymphocyte Stimulator or B Lymphocyte Stimulator receptor expression or inappropriate function of B Lymphocyte Stimulator or B Lymphocyte Stimulator receptor in an animal, preferably a mammal, and most preferably a human, comprising, or alternatively consisting of, use of antibodies (including molecules comprising, or alternatively consisting of, antibody fragments or variants thereof) that immunospecifically bind to B Lymphocyte Stimulator. Diseases and disorders which can be detected, diagnosed, or prognosed with the antibodies (including molecules comprising, or alternatively consisting of, antibody fragments or variants thereof) of the invention include, but are not limited to, immune disorders (e.g., lupus, rheumatoid arthritis, multiple sclerosis, myasthenia gravis, Hashimoto's disease, and immunodeficiency syndrome), inflammatory disorders (e.g., asthma, allergic disorders, and rheumatoid arthritis), infectious diseases (e.g., AIDS), and proliferative disorders (e.g., leukemia, carcinoma, and lymphoma). The present invention further encompasses methods and compositions for preventing, treating or ameliorating diseases or disorders associated with aberrant B Lymphocyte Stimulator or B Lymphocyte Stimulator receptor expression or inappropriate function of B Lymphocyte Stimulator or B Lymphocyte Stimulator receptor in an animal, preferably a mammal, and most preferably a human, comprising, or alternatively consisting of, administering to said animal an effective amount of one or more antibodies (including molecules comprising, or alternatively consisting of, antibody fragments or variants thereof) that immunospecifically bind to B Lymphocyte Stimulator. Diseases and disorders which can be prevented, treated or ameliorated by administering an effective amount of an antibody of the invention include, but are not limited to, immune disorders (e.g., lupus, rheumatoid arthritis, multiple sclerosis, myasthenia gravis, Hashimoto's disease, and immunodeficiency syndrome), inflammatory disorders (e.g., asthma, allergic disorders, and rheumatoid arthritis), infectious diseases (e.g., AIDS), and proliferative disorders (e.g., leukemia, carcinoma, and lymphoma).

Using phage display technology, the present inventors have identified single chain antibody molecules ("scFvs") that immunospecifically bind to B Lymphocyte Stimulator, including scFvs that immunospecifically bind to soluble B Lymphocyte Stimulator, scFvs that immunospecifically bind the membrane-bound form of B Lymphocyte Stimulator, and scFvs that immunospecifically bind to both the soluble form and the membrane-bound form of B Lymphocyte Stimulator. Molecules comprising, or alternatively consisting of, fragments or variants of these scFvs (e.g., including VH domains, VH CDRs, VL domains, or VL CDRs having an amino acid sequence of any one of those referred to in Table 1), that immunospecifically bind the soluble form of B Lymphocyte Stimulator, the membrane-bound form of B Lymphocyte Stimulator, and/or both the soluble form and membrane-bound form of B Lymphocyte Stimulator, are also encompassed by the invention, as are nucleic acid molecules that encode these scFvs, and/or molecules.

In particular, the invention relates to scFvs comprising, or alternatively consisting of, an amino acid sequence selected from the group consisting of SEQ ID NOS: 1–2128, preferably SEQ ID NOS:834–872, 1570–1595, and 1886–1908, and most preferably SEQ ID NOS:1–46, 321–329, 1563–1569, and 1881–1885, as referred to in Table 1 below. In specific embodiments, the present invention relates to scFvs that immunospecifically bind the soluble form of B Lymphocyte Stimulator, said scFvs comprising, or alternatively consisting of, an amino acid sequence of SEQ ID NOS: 1563–1569, preferably SEQ ID NOS:1570–1595, and most preferably SEQ ID NOS: 1563–1569, as referred to in Table 1, below. In other embodiments, the present invention also relates to scFvs that immunospecifically bind the membrane-bound form of B Lymphocyte Stimulator, said scFvs comprising, or alternatively consisting of, an amino acid sequence of SEQ ID NOS: 1881–2128, preferably SEQ ID NOS:1886–1908, and most preferably SEQ ID NOS: 1881–1885, as referred to in Table 1 below. The present invention further relates to scFvs that immunospecifically bind both the membrane-bound form and soluble form of B Lymphocyte Stimulator, said scFvs comprising, or alternatively consisting of, an amino acid sequence of SEQ ID NOS: 1–1562, preferably SEQ ID NOS: 834–872, and most preferably SEQ ID NOS: 1–46, and 321–329, as referred to in Table 1 below. Molecules comprising, or alternatively consisting of, fragments or variants of these scFvs (e.g., including VH domains, VH CDRs, VL domains, or VL CDRs having an amino acid sequence of any one of those referred to in Table 1), that immunospecifically bind the soluble form of B Lymphocyte Stimulator, the membrane-bound form of B Lymphocyte Stimulator, and/or both the soluble form and membrane-bound form of B Lymphocyte Stimulator, are also encompassed by the invention, as are nucleic acid molecules that encode these scFvs, and/or molecules.

The present invention provides antibodies (including molecules comprising, or alternatively consisting of, antibody fragments or variants thereof) that immunospecifically bind to a polypeptide or polypeptide fragment of B Lymphocyte Stimulator, said antibodies comprising, or alternatively consisting of, a polypeptide having the amino acid sequence of any one of the variable heavy ("VH") domains referred to in Table 1, below, or any one of the variable light ("VL") domains referred to in Table 1. In a preferred embodiment, antibodies of the present invention comprise, or alternatively consist of, a polypeptide having the amino acid sequence of a VH domain contained in SEQ ID NOS:1–46, 321–329, 834–872, 1563–1595, or 1881–1908, as referred to in Table 1 below. In another preferred embodiment, antibodies (including molecules comprising or alternatively consisting of, antibody fragments or variants thereof) of the present invention comprise, or alternatively consist of, a polypeptide having the amino acid sequence of a VL domain contained SEQ ID NOS:1–46, 321–329, 834–872, 1563–1595, or 1881–1908, as referred to in Table 1 below. Molecules comprising, or alternatively consisting of, fragments or variants of these antibodies (e.g., including VH domains, VH CDRs, VL domains, or VL CDRs having an amino acid sequence of any one of those referred to in Table 1), that immunospecifically bind the soluble form of B Lymphocyte Stimulator, the membrane-bound form of B Lymphocyte Stimulator, and/or both the soluble form and membrane-bound form of B Lymphocyte Stimulator, are also encompassed by the invention, as are nucleic acid molecules that encode these antibodies, and/or molecules.

The present invention also provides antibodies (including molecules comprising or alternatively consisting of, antibody fragments or variants thereof) that immunospecifically bind to a polypeptide or a polypeptide fragment of B Lymphocyte Stimulator, said antibodies comprising, or alternatively consisting of, a polypeptide having the amino acid sequence of any one of the VH domains referred to in Table 1, below, and any one of the VL domains referred to in Table 1. In a preferred embodiment, the antibodies of the invention comprise or alternatively consist of, a polypeptide having the amino acid sequence of a VH and VL domain contained in the same scFv referred to in Table 1. In another preferred embodiment, antibodies of the present invention, comprise, or alternatively consist of, a VH domain from an scFv of SEQ ID NOS:1–46, 321–329, 834–872, 1563–1595, or 1881–1908, as disclosed in Table 1, and a VL domain from an scFv SEQ ID NOS:1–46, 321–329, 834–872, 1563–1595, or 1881–1908, as disclosed in Table 1. In another preferred embodiment, antibodies of the present invention comprise, or alternatively consist of, the VH and VL domain from a single scFv of SEQ ID NOS:1–46, 321–329, 834–872, 1563–1595, or 1881–1908, as disclosed in Table 1. Molecules comprising, or alternatively consisting of, fragments or variants of these antibodies (e.g., including VH domains, VH CDRs, VL domains, or VL CDRs having an amino acid sequence of any one of those referred to in Table 1), that immunospecifically bind the soluble form of B Lymphocyte Stimulator, the membrane-bound form of B Lymphocyte Stimulator, and/or both the soluble form and membrane-bound form of B Lymphocyte Stimulator, are also encompassed by the invention, as are nucleic acid molecules that encode these antibodies, and/or molecules.

The present invention also provides antibodies (including molecules comprising, or alternatively consisting of, antibody fragments or variants thereof) that immunospecifically bind to a polypeptide or a polypeptide fragment of B Lymphocyte Stimulator, said antibodies comprising, or alternatively consisting of, a polypeptide having the amino acid sequence of any one, two, three or more of the VH complementarity determining regions ("CDRs") (i.e., VH CDR1, VH CDR2, or VH CDR3) referred to in Table 1 and/or any one, two, three or more of the VL CDRs (i.e., VL CDR1, VL CDR2, or VL CDR3) referred to in Table 1. In one embodiment, antibodies of the present invention comprise, or alternatively consist of, a polypeptide having the amino acid sequence of any one of the VH CDR1s referred to in Table 1 and/or any one of the VL CDR1s referred to in Table 1. In another embodiment, antibodies of the present invention comprise, or alternatively consist of, a polypeptide having the amino acid sequence of any one of the VH CDR2s referred to in Table 1 and/or any one of the VL CDR2s referred to in Table 1. In a preferred embodiment, antibodies of the present invention comprise, or alternatively consist of, a polypeptide having the amino acid sequence of any one of the VH CDR3s referred to in Table 1 and/or any one of the VL CDR3s referred to in Table 1. Molecules comprising, or alternatively consisting of, fragments or variants of these antibodies (e.g., including VH domains, VH CDRs, VL domains, or VL CDRs having an amino acid sequence of any one of those referred to in Table 1), that immunospecifically bind the soluble form of B Lymphocyte Stimulator, the membrane-bound form of B Lymphocyte Stimulator, and/or both the soluble form and membrane-bound form of B Lymphocyte Stimulator, are also encompassed by the invention, as are nucleic acid molecules that encode these antibodies, and/or molecules.

In another embodiment, antibodies of the present invention (including molecules comprising, or alternatively consisting of, antibody fragments or variants thereof) immunospecifically bind to a polypeptide or polypeptide fragment of B Lymphocyte Stimulator, and comprise, or alternatively consist of, a polypeptide having the amino acid sequence of any one of the VH CDR1s referred to in Table 1, any one of the VH CDR2s referred to in Table 1, and/or any one of the VH CDR3s referred to in Table 1. In another embodiment, antibodies of the present invention comprise, or alternatively consist of, a polypeptide having the amino acid sequence of any one of the VL CDR1s referred to in Table 1, any one of the VL CDR2s referred to in Table 1, and/or any one of the VL CDR3s referred to in Table 1. In a preferred embodiment, antibodies of the present invention comprise, or alternatively consist of, at least one, two, three, four, five, six, or more CDRs that correspond to the same scFv referred to in Table 1, more preferably where CDR1, CDR2, and CDR3 of the VL domain correspond to the same scFv or where CDR1, CDR2, and CDR3 of the VH domain correspond to the same scFv, and most preferably where all six CDRs correspond to the same scFv referred to in Table 1. Molecules comprising, or alternatively consisting of, fragments or variants of these antibodies (e.g., including VH domains, VH CDRs, VL domains, or VL CDRs having an amino acid sequence of any one of those referred to in Table 1), that immunospecifically bind the soluble form of B Lymphocyte Stimulator, the membrane-bound form of B Lymphocyte Stimulator, and/or both the soluble form and membrane-bound form of B Lymphocyte Stimulator, are also encompassed by the invention, as are nucleic acid molecules that encode these antibodies, and/or molecules.

The present invention also provides antibodies (including molecules comprising, or alternatively consisting of, antibody fragments or variants thereof) that: immunospecifically bind to the soluble form of B Lymphocyte Stimulator (e.g., a polypeptide consisting of amino acids 134–285 of SEQ ID NO:3228); that immunospecifically bind to the membrane-bound form of B Lymphocyte Stimulator (e.g., a polypeptide consisting of amino acids 1–285 of SEQ ID NO:3228 or a B Lymphocyte Stimulator polypeptide expressed on the surface of monocytes) and/or that immunospecifically bind to both the soluble form and membrane-bound form of B Lymphocyte Stimulator. In a preferred embodiment, antibodies of the present invention immunospecifically bind to the soluble form of B Lymphocyte Stimulator and comprise, or alternatively consist of, a VH domain, VH CDR1, VH CDR2, VH CDR3, VL domain, VL CDR1, VL CDR2, and/or VL CDR3 corresponding to one or more scFvs, that immunospecifically bind to the soluble form of B Lymphocyte Stimulator. In another preferred embodiment, antibodies of the present invention immunospecifically bind to the membrane-bound form of B Lymphocyte Stimulator and comprise, or alternatively consist of, a VH domain, VH CDR1, VH CDR2, VH CDR3, VL domain, VL CDR1, VL CDR2, and/or VL CDR3 corresponding to one or more scFvs, that immunospecifically bind to the membrane-bound form of B Lymphocyte Stimulator. In yet another preferred embodiment, antibodies of the present invention immunospecifically bind to the soluble form and membrane-bound form of B Lymphocyte Stimulator and comprise, or alternatively consist of, a VH domain, VH CDR1, VH CDR2, VH CDR3, VL domain, VL CDR1, VL CDR2, and/or VL CDR3 corresponding to one or more scFvs, that immunospecifically binds to the soluble form and membrane-bound form of B Lymphocyte Stimulator. In another preferred embodiment, antibodies of the present invention comprise, or alternatively consist of, a VH domain and a VL domain corresponding to the same scFv disclosed in Table 1, which antibodies immunospecifically bind to the soluble form of B Lymphocyte Stimulator, the membrane-bound form of B Lymphocyte Stimulator, or both the soluble form and membrane-bound form of B Lymphocyte Stimulator. Nucleic acid molecules encoding these antibodies are also encompassed by the invention. Molecules comprising, or alternatively consisting of, fragments or variants of these antibodies (e.g., including VH domains, VH CDRs, VL domains, or VL CDRs having an amino acid sequence of any one of those referred to in Table 1), that immunospecifically bind the soluble form of B Lymphocyte Stimulator, the membrane-bound form of B Lymphocyte Stimulator, and/or both the soluble form and membrane-bound form of B Lymphocyte Stimulator, are also encompassed by the invention, as are nucleic acid molecules that encode these antibodies, and/or molecules.

A VH domain of an amino acid sequence disclosed herein may be combined with a VL domain of an amino acid sequence disclosed herein, or other VL domains, to provide a VH/VL pairing representing an antigen-binding site of an antibody. Similarly, a VL domain of an amino acid sequence disclosed herein may be combined with a VH domain of an amino acid sequence disclosed herein, or other VH domains. Further, one or more CDRs disclosed herein may be taken from a VH or VL domain and incorporated into a suitable framework as discussed infra.

The present invention provides antibodies (including molecules comprising, or alternatively consisting of, antibody fragments or variants thereof (including derivatives)) comprising, or alternatively consisting of, of VH domains, VL domains and/or CDRs described herein, which antibodies, immunospecifically bind to B Lymphocyte Stimulator (e.g., soluble B Lymphocyte Stimulator and membrane-bound B Lymphocyte Stimulator) and can be routinely assayed for immunospecific binding to B Lymphocyte Stimulator using methods known in the art, such as, for example, the immunoassays disclosed infra. Antibodies and antibody fragments or variants (including derivatives) of the invention may include, for example, one or more amino acid sequence alterations (addition, deletion, substitution and/or insertion of an amino acid residue). These alterations may be made in one or more framework regions and/or one or more CDR's.

The antibodies of the invention (including antibody fragments, and variants and derivative thereof) can be routinely made by methods known in the art. Molecules comprising, or alternatively consisting of, fragments or variants of any of the VH domains, VH CDRs, VL domains, and VL CDRs whose sequences are specifically disclosed herein may be employed in accordance with the present invention. Nucleic acid molecules encoding these antibodies and molecules (including fragments, variants, and derivatives) are also encompassed by the invention.

The present invention also provides panels of antibodies (including molecules comprising, or alternatively consisting of, antibody fragments or variants) wherein the panel members correspond to one, two, three, four, five, ten, fifteen, twenty, or more different antibodies of the invention (e.g., whole antibodies, Fabs, $F(ab')_2$ fragments, Fd fragments, disulfide-linked Fvs (sdFvs), antiidiotypic (anti-Id) antibodies, and scFvs). The present invention further provides mixtures of antibodies, wherein the mixture corresponds to one, two, three, four, five, ten, fifteen, twenty, or more different antibodies of the invention (e.g., whole antibodies, Fabs, $F(ab')_2$ fragments, Fd fragments, disulfide-linked Fvs (sdFvs), antiidiotypic (anti-Id) antibodies, and scFvs)). The present invention also provides for compositions comprising, or alternatively consisting of, one, two, three, four, five, ten, fifteen, twenty, or more antibodies of the present invention (including molecules comprising, or alternatively consisting of, antibody fragments or variants thereof). A composition of the invention may comprise, or alternatively consist of, one, two, three, four, five, ten, fifteen, twenty, or more amino acid sequences of one or more antibodies or fragments or variants thereof. Alternatively, a composition of the invention may comprise, or alternatively consist of, nucleic acid molecules encoding one or more antibodies of the invention.

The present invention also provides for fusion proteins comprising an antibody (including molecules comprising, or alternatively consisting of, antibody fragments or variants thereof) of the invention, and a heterologous polypeptide (i.e., a polypeptide unrelated to an antibody or antibody domain). Nucleic acid molecules encoding these fusion proteins are also encompassed by the invention. A composition of the present invention may comprise, or alternatively consist of, one, two, three, four, five, ten, fifteen, twenty or more fusion proteins of the invention. Alternatively, a composition of the invention may comprise, or alternatively consist of, nucleic acid molecules encoding one, two, three, four, five, ten, fifteen, twenty or more fusion proteins of the invention.

The present invention also provides for a nucleic acid molecule, generally isolated, encoding an antibody (including molecules such as scFvs, which comprise, or alternatively consist of, an antibody fragment or variant thereof) of the invention. The present invention also provides a host cell transformed with a nucleic acid molecule of the invention and progeny thereof. The present invention also provides a method for the production of an antibody (including a molecule comprising, or alternatively consisting of, an antibody fragment or variant thereof) of the invention. The present invention further provides a method of expressing an antibody (including a molecule comprising, or alternatively consisting of, an antibody fragment or variant thereof) of the invention from a nucleic acid molecule. These and other aspects of the invention are described in further detail below.

The present invention also encompasses methods and compositions for detecting, diagnosing and/or prognosing diseases or disorders associated with aberrant B Lymphocyte Stimulator or B Lymphocyte Stimulator receptor expression or inappropriate B Lymphocyte Stimulator or B Lymphocyte Stimulator receptor function in an animal, preferably a mammal, and most preferably a human, comprising using antibodies (including molecules which comprise, or alternatively consist of, antibody fragments or variants thereof) that immunospecifically bind to B Lymphocyte Stimulator. Diseases and disorders which can be detected, diagnosed or prognosed with the antibodies of the invention include, but are not limited to, immune disorders (e.g., lupus, rheumatoid arthritis, multiple sclerosis, myasthenia gravis, Hashimoto's disease, and immunodeficiency syndrome), inflammatory disorders (e.g., asthma, allergic disorders, and rheumatoid arthritis), infectious diseases (e.g., AIDS), and proliferative disorders (e.g., leukemia, carcinoma, and lymphoma).

In specific embodiments, the present invention encompasses methods and compositions for detecting, diagnosing and/or prognosing diseases or disorders associated with hypergammaglobulinemia (e.g., AIDS, autoimmune diseases, and some immunodeficiencies). In other specific embodiments, the present invention encompasses methods and compositions for detecting, diagnosing and/or prognosing diseases or disorders associated with hypogammaglobulinemia (e.g., an immunodeficiency).

The present invention further encompasses methods and compositions for preventing, treating or ameliorating diseases or disorders associated with aberrant B Lymphocyte Stimulator or B Lymphocyte Stimulator receptor expression or inappropriate B Lymphocyte Stimulator or B Lymphocyte Stimulator receptor function in an animal, preferably a mammal, and most preferably a human, comprising administering to said animal an effective amount of one or more antibodies (including molecules which comprise, or alternatively consist of, antibody fragments or variants thereof) that immunospecifically bind to B Lymphocyte Stimulator. Diseases and disorders which can be prevented, treated or inhibited by administering an effective amount of one or more antibodies or molecules of the invention include, but are not limited to, immune disorders (e.g., lupus, rheumatoid arthritis, multiple sclerosis, myasthenia gravis, Hashimoto's disease, and immunodeficiency syndrome), inflammatory disorders (e.g., asthma, allergic disorders, and rheumatoid arthritis), infectious diseases (e.g., AIDS), and proliferative disorders (e.g., leukemia, carcinoma, and lymphoma).

In specific embodiments, the present invention encompasses methods and compositions (e.g., antagonistic anti-B Lymphocyte Stimulator antibodies) for preventing, treating or ameliorating diseases or disorders associated with hypergammaglobulinemia (e.g., AIDS, autoimmune diseases, and some immunodeficiency syndromes). In other specific embodiments, the present invention encompasses methods and compositions (e.g., agonistic anti-B Lymphocyte Stimulator antibodies) for preventing, treating or ameliorating diseases or disorders associated with hypogammaglobulinemia (e.g., an immunodeficiency syndrome).

Autoimmune disorders, diseases, or conditions that may be detected, diagnosed, prognosed, or monitored using the antibodies of the invention include, but are not limited to, autoimmune hemolytic anemia, autoimmune neonatal thrombocytopenia, idiopathic thrombocytopenia purpura, autoimmune neutropenia, autoimmunocytopenia, hemolytic anemia, antiphospholipid syndrome, dermatitis, gluten-sensitive enteropathy, allergic encephalomyelitis, myocarditis, relapsing polychondritis, rheumatic heart disease, glomerulonephritis (e.g., IgA nephropathy), Multiple Sclerosis, Neuritis, Uveitis Ophthalmia, Polyendocrinopathies, Purpura (e.g., Henloch-Scoenlein purpura), Reiter's Disease, Stiff-Man Syndrome, Autoimmune Pulmonary Inflammation, myocarditis, IgA glomerulonephritis, dense deposit disease, rheumatic heart disease, Guillain-Barre Syndrome, insulin dependent diabetes mellitis, and autoimmune inflammatory eye, autoimmune thyroiditis, hypothyroidism (i.e., Hashimoto's thyroiditis, systemic lupus erhythematosus, discoid lupus, Goodpasture's syndrome, Pemphigus, Receptor autoimmunities such as, for example, (a) Graves' Disease, (b) Myasthenia Gravis, and (c) insulin resistance, autoimmune hemolytic anemia, autoimmune thrombocytopenic purpura, rheumatoid arthritis, schleroderma with anti-collagen antibodies, mixed connective tissue disease, polymyositis/dermatomyositis, pernicious anemia, idiopathic Addison's disease, infertility, glomerulonephritis such as primary glomerulonephritis and IgA nephropathy, bullous pemphigoid, Sjögren's syndrome, diabetes mellitus, and adrenergic drug resistance (including adrenergic drug resistance with asthma or cystic fibrosis), chronic active hepatitis, primary biliary cirrhosis, other endocrine gland failure, vitiligo, vasculitis, post-MI, cardiotomy syndrome, urticaria, atopic dermatitis, asthma, inflammatory myopathies, and other inflammatory, granulomatous, degenerative, and atrophic disorders).

Immunodeficiencies that may be detected, diagnosed, prognosed, or monitored using the antibodies of the invention include, but are not limited to, severe combined immunodeficiency (SCID)-X linked, SCID-autosomal, adenosine deaminase deficiency (ADA deficiency), X-linked agammaglobulinemia (XLA), Bruton's disease, congenital agammaglobulinemia, X-linked infantile agammaglobulinemia, acquired agammaglobulinemia, adult onset agammaglobulinemia, late-onset agammaglobulinemia, dysgammaglobulinemia, hypogammaglobulinemia, transient hypogammaglobulinemia of infancy, unspecified hypogammaglobulinemia, agammaglobulinemia, common variable immunodeficiency (CVID) (acquired), Wiskott-Aldrich Syndrome (WAS), X-linked immunodeficiency with hyper IgM, non X-linked immunodeficiency with hyper IgM, selective IgA deficiency, IgG subclass deficiency (with or without IgA deficiency), antibody deficiency with normal or elevated Igs, immunodeficiency with thymoma, Ig heavy chain deletions, kappa chain deficiency, B cell lymphoproliferative disorder (BLPD), selective IgM immunodeficiency, recessive agammaglobulinemia (Swiss type), reticular dysgenesis, neonatal neutropenia, severe congenital leukopenia, thymic alymphoplasia-aplasia or dysplasia with immunodeficiency, ataxia-telangiectasia, short limbed dwarfism, X-linked lymphoproliferative syndrome (XLP), Nezelof syndrome-combined immunodeficiency with Igs, purine nucleoside phosphorylase deficiency (PNP), MHC Class II deficiency (Bare Lymphocyte Syndrome) and severe combined immunodeficiency.

Definitions

The term "antibody," as used herein, refers to immunoglobulin molecules and immunologically active portions of immunoglobulin molecules, i.e., molecules that contain an antigen binding site that immunospecifically binds an antigen. As such, the term antibody encompasses not only whole antibody molecules, but also antibody fragments as well as variants (including derivatives) of antibodies and antibody fragments. Examples of molecules which are described by the term "antibody" in this application include, but are not limited to: single chain Fvs (scFvs), Fab fragments, Fab' fragments, $F(ab')_2$, disulfide linked Fvs (sdFvs), Fvs, and fragments comprising or alternatively consisting of, either a VL or a VH domain. The term "single chain Fv" or "scFv" as used herein refers to a polypeptide comprising a VL domain of antibody linked to a VH domain of an antibody. Antibodies that immunospecifically bind to B Lymphocyte Stimulator may have cross-reactivity with other antigens. Preferably, antibodies that immunospecifically bind to B Lymphocyte Stimulator do not cross-react with other antigens. Antibodies that immunospecifically bind to B Lymphocyte Stimulator can be identified, for example, by immunoassays or other techniques known to those of skill in the art, e.g., the immunoassays described in the Examples below.

Antibodies of the invention include, but are not limited to, monoclonal, multispecific, human or chimeric antibodies, single chain antibodies, Fab fragments, F(ab') fragments, antiidiotypic (anti-Id) antibodies (including, e.g., anti-Id antibodies to antibodies of the invention), and epitope-binding fragments of any of the above. The immunoglobulin molecules of the invention can be of any type (e.g., IgG, IgE, IgM, IgD, IgA and IgY), class (e.g., $IgG_1$, $IgG_2$, $IgG_3$, $IgG_4$, $IgA_1$ and $IgA_2$) or subclass of immunoglobulin molecule.

Preferably, an antibody of the invention comprises, or alternatively consists of, a VH domain, VH CDR, VL domain, or VL CDR having an amino acid sequence of any one of those referred to in Table 1, or a fragment or variant thereof.

An antibody of the invention "which binds the soluble form of B Lymphocyte Stimulator" is one which binds the 152 amino acid soluble form of the B Lymphocyte Stimulator protein (amino acids 134–285 of SEQ ID NO:3228). In specific embodiments of the invention, an antibody of the invention "which binds the soluble form of B Lymphocyte Stimulator" does not also bind the membrane-bound or membrane-associated form of B Lymphocyte Stimulator. Assays which measure binding to the soluble form of B Lymphocyte Stimulator include, but are not limited to, receptor binding inhibition assay or capture of soluble B Lymphocyte Stimulator from solution as described in Examples 8 and 9.

An antibody of the invention "which binds the membrane-bound form of B Lymphocyte Stimulator" is one which binds the membrane-associated (uncleaved) B Lymphocyte Stimulator protein. In specific embodiments of the invention, an antibody of the invention "which binds the membrane-bound form of B Lymphocyte Stimulator" does not also bind the soluble form of B Lymphocyte Stimulator. Binding to HIS-tagged B Lymphocyte Stimulator (as described herein) in an ELISA is an indicator that an antibody binds the membrane-bound form of B Lymphocyte Stimulator, but should not be relied upon as proof of specificity for the membrane-bound form of B Lymphocyte Stimulator. Assays that may be relied upon as proof of an antibody's specificity for membrane-bound B Lymphocyte Stimulator, include, but are not limited to, binding to plasma membranes expressing B Lymphocyte Stimulator as described in Example 2. An antibody of the invention "which binds the both the soluble form and the membrane-bound form of B Lymphocyte Stimulator" is one which binds both the membrane-bound form and the soluble form of B Lymphocyte Stimulator.

The term "variant" as used herein refers to a polypeptide that possesses a similar or identical function as a B Lymphocyte Stimulator polypeptide, a fragment of B Lymphocyte Stimulator, an anti-B Lymphocyte Stimulator antibody or antibody fragment thereof, but does not necessarily comprise a similar or identical amino acid sequence of a B Lymphocyte Stimulator polypeptide, a fragment of B Lymphocyte Stimulator, an anti-B Lymphocyte Stimulator antibody or antibody fragment thereof, or possess a similar or identical structure of a B Lymphocyte Stimulator polypeptide, a fragment of B Lymphocyte Stimulator, an anti-B Lymphocyte Stimulator antibody or antibody fragment thereof. A variant having a similar amino acid refers to a polypeptide that satisfies at least one of the following: (a) a polypeptide comprising, or alternatively consisting of, an amino acid sequence that is at least 30%, at least 35%, at least 40%, at least 45%, at least 50%, at least 55%, at least 60%, at least 65%, at least 70%, at least 75%, at least 80%, at least 85%, at least 90%, at least 95% or at least 99% identical to the amino acid sequence of a B Lymphocyte Stimulator polypeptide, a fragment of B Lymphocyte Stimulator, an anti-B Lymphocyte Stimulator antibody or antibody fragment thereof (including a VH domain, VHCDR, VL domain, or VLCDR having an amino acid sequence of any one of those referred to in Table 1) described herein; (b) a polypeptide encoded by a nucleotide sequence, the complementary sequence of which hybridizes under stringent conditions to a nucleotide sequence encoding a B Lymphocyte Stimulator polypeptide (e.g., SEQ ID NO:3228), a fragment of B Lymphocyte Stimulator, an anti-B Lymphocyte Stimulator antibody or antibody fragment thereof (including a VH domain, VHCDR, VL domain, or VLCDR having an amino acid sequence of any one of those referred to in Table 1), described herein, of at least 5 amino acid residues, at least 10 amino acid residues, at least 15 amino acid residues, at least 20 amino acid residues, at least 25 amino acid residues, at least 30 amino acid residues, at least 40 amino acid residues, at least 50 amino acid residues, at least 60 amino residues, at least 70 amino acid residues, at least 80 amino acid residues, at least 90 amino acid residues, at least 100 amino acid residues, at least 125 amino acid residues, or at least 150 amino acid residues; and (c) a polypeptide encoded by a nucleotide sequence that is at least 30%, at least 35%, at least 40%, at least 45%, at least 50%, at least 55%, at least 60%, at least 65%, at least 70%, at least 75%, at least 80%, at least 85%, at least 90%, at least 95% or at least 99%, identical to the nucleotide sequence encoding a B Lymphocyte Stimulator polypeptide, a fragment of B Lymphocyte Stimulator, an anti-B Lymphocyte Stimulator antibody or antibody fragment thereof (including a VH domain, VHCDR, VL domain, or VLCDR having an amino acid sequence of any one of those referred to in Table 1), described herein. A polypeptide with similar structure to a B Lymphocyte Stimulator polypeptide, a fragment of B Lymphocyte Stimulator, an anti-B Lymphocyte Stimulator antibody or antibody fragment thereof, described herein refers to a polypeptide that has a similar secondary, tertiary or quarternary structure of a B Lymphocyte Stimulator polypeptide, a fragment of B Lymphocyte Stimulator, an anti-B Lymphocyte Stimulator antibody, or antibody fragment thereof, described herein. The structure of a polypeptide can determined by methods known to those skilled in the art, including but not limited to, X-ray crystallography, nuclear magnetic resonance, and crystallographic electron microscopy.

To determine the percent identity of two amino acid sequences or of two nucleic acid sequences, the sequences are aligned for optimal comparison purposes (e.g., gaps can be introduced in the sequence of a first amino acid or nucleic acid sequence for optimal alignment with a second amino acid or nucleic acid sequence). The amino acid residues or nucleotides at corresponding amino acid positions or nucleotide positions are then compared. When a position in the first sequence is occupied by the same amino acid residue or nucleotide at the corresponding position in the second sequence, then the molecules are identical at that position. The percent identity between the two sequences is a function of the number of identical positions shared by the sequences (i.e., % identity=number of identical overlapping positions/total number of positions×100%). In one embodiment, the two sequences are the same length.

The determination of percent identity between two sequences can be accomplished using a mathematical algorithm known to those of skill in the art. An example of a mathematical algorithm for comparing two sequences is the algorithm of Karlin and Altschul *Proc. Natl. Acad. Sci. USA* 87:2264–2268(1990), modified as in Karlin and Altschul *Proc. Natl. Acad. Sci. USA* 90:5873–5877(1993). The BLASTn and BLASTx programs of Altschul, et al. *J. Mol. Biol.* 215:403–410(1990) have incorporated such an alogrithm. BLAST nucleotide searches can be performed with the BLASTn program, score=100, wordlength=12 to obtain nucleotide sequences homologous to a nucleic acid molecules of the invention. BLAST protein searches can be performed with the BLASTx program, score=50, wordlength=3 to obtain amino acid sequences homologous to a protein molecules of the invention. To obtain gapped alignments for comparison purposes, Gapped BLAST can be utilized as described in Altschul et al. *Nucleic Acids Res.* 25:3389–3402(1997). Alternatively, PSI-BLAST can be used to perform an iterated search which detects distant relationships between molecules (Id.). When utilizing BLAST, Gapped BLAST, and PSI-BLAST programs, the default parameters of the respective programs (e.g., BLASTx and BLASTn) can be used. (See http://www.ncbi.nlm.nih.gov.)

Another example of a mathematical algorithm utilized for the comparison of sequences is the algorithm of Myers and Miller, CABIOS (1989). The ALIGN program (version 2.0) which is part of the GCG sequence alignment software package has incorporated such an alogrithm. Other algorithms for sequence analysis known in the art include ADVANCE and ADAM as described in Torellis and Robotti *Comput. Appl. Biosci.,* 10: 3–5(1994); and FASTA described in Pearson and Lipman *Proc. Natl. Acad. Sci.* 85:2444–8 (1988). Within FASTA, ktup is a control option that sets the sensitivity and speed of the search.

The term "derivative" as used herein, refers to a variant polypeptide of the invention that comprises, or alternatively consists of, an amino acid sequence of a B Lymphocyte Stimulator polypeptide, a fragment of B Lymphocyte Stimulator, or an antibody of the invention that immunospecifically binds to B Lymphocyte Stimulator, which has been altered by the introduction of amino acid residue substitutions, deletions or additions. The term "derivative" as used herein also refers to a B Lymphocyte Stimulator polypeptide, a fragment of B Lymphocyte Stimulator, an antibody that immunospecifically binds to B Lymphocyte Stimulator which has been modified, e.g., by the covalent attachment of any type of molecule to the polypeptide. For example, but not by way of limitation, a B Lymphocyte Stimulator polypeptide, a fragment of B Lymphocyte Stimulator, or an anti-B Lymphocyte Stimulator antibody, may be modified, e.g., by glycosylation, acetylation, pegylation, phosphorylation, amidation, derivatization by known protecting/blocking groups, proteolytic cleavage, linkage to a cellular ligand or other protein, etc. A derivative of a B Lymphocyte Stimulator polypeptide, a fragment of B Lymphocyte Stimulator, or an anti-B Lymphocyte Stimulator antibody, may be modified by chemical modifications using techniques known to those of skill in the art, including, but not limited to, specific chemical cleavage, acetylation, formylation, metabolic synthesis of tunicamycin, etc. Further, a derivative of a B Lymphocyte Stimulator polypeptide, a fragment of B Lymphocyte Stimulator, or an anti-B Lymphocyte Stimulator antibody, may contain one or more non-classical amino acids. A polypeptide derivative possesses a similar or identical function as a B Lymphocyte Stimulator polypeptide, a fragment of B Lymphocyte Stimulator, or an anti-B Lymphocyte Stimulator antibody, described herein.

The term "epitopes" as used herein refers to portions of B Lymphocyte Stimulator having antigenic or immunogenic activity in an animal, preferably a mammal. An epitope having immunogenic activity is a portion of B Lymphocyte Stimulator that elicits an antibody response in an animal. An eptiope having antigenic activity is a portion of B Lymphocyte Stimulator to which an antibody immunospecifically binds as determined by any method known in the art, for example, by the immunoassays described herein. Antigenic epitopes need not necessarily be immunogenic.

The term "fragment" as used herein refers to a polypeptide comprising an amino acid sequence of at least 5 amino acid residues, at least 10 amino acid residues, at least 15 amino acid residues, at least 20 amino acid residues, at least 25 amino acid residues, at least 30 amino acid residues, at least 35 amino acid residues, at least 40 amino acid residues, at least 45 amino acid residues, at least 50 amino acid residues, at least 60 amino residues, at least 70 amino acid residues, at least 80 amino acid residues, at least 90 amino acid residues, at least 100 amino acid residues, at least 125 amino acid residues, at least 150 amino acid residues, at least 175 amino acid residues, at least 200 amino acid residues, or at least 250 amino acid residues, of the amino acid sequence of B Lymphocyte Stimulator, or an anti-B Lymphocyte, Stimulator antibody (including molecules such as scFv's, that comprise, or alternatively consist of, antibody fragments or variants thereof) that immunospecifically binds to B Lymphocyte Stimulator.

The term "fusion protein" as used herein refers to a polypeptide that comprises, or alternatively consists of, an amino acid sequence of an anti-B Lymphocyte Stimulator antibody of the invention and an amino acid sequence of a heterologous polypeptide (i.e., a polypeptide unrelated to an antibody or antibody domain).

The term "host cell" as used herein refers to the particular subject cell transfected with a nucleic acid molecule and the progeny or potential progeny of such a cell. Progeny may not be identical to the parent cell transfected with the nucleic acid molecule due to mutations or environmental influences that may occur in succeeding generations or integration of the nucleic acid molecule into the host cell genome.

Figure 7:
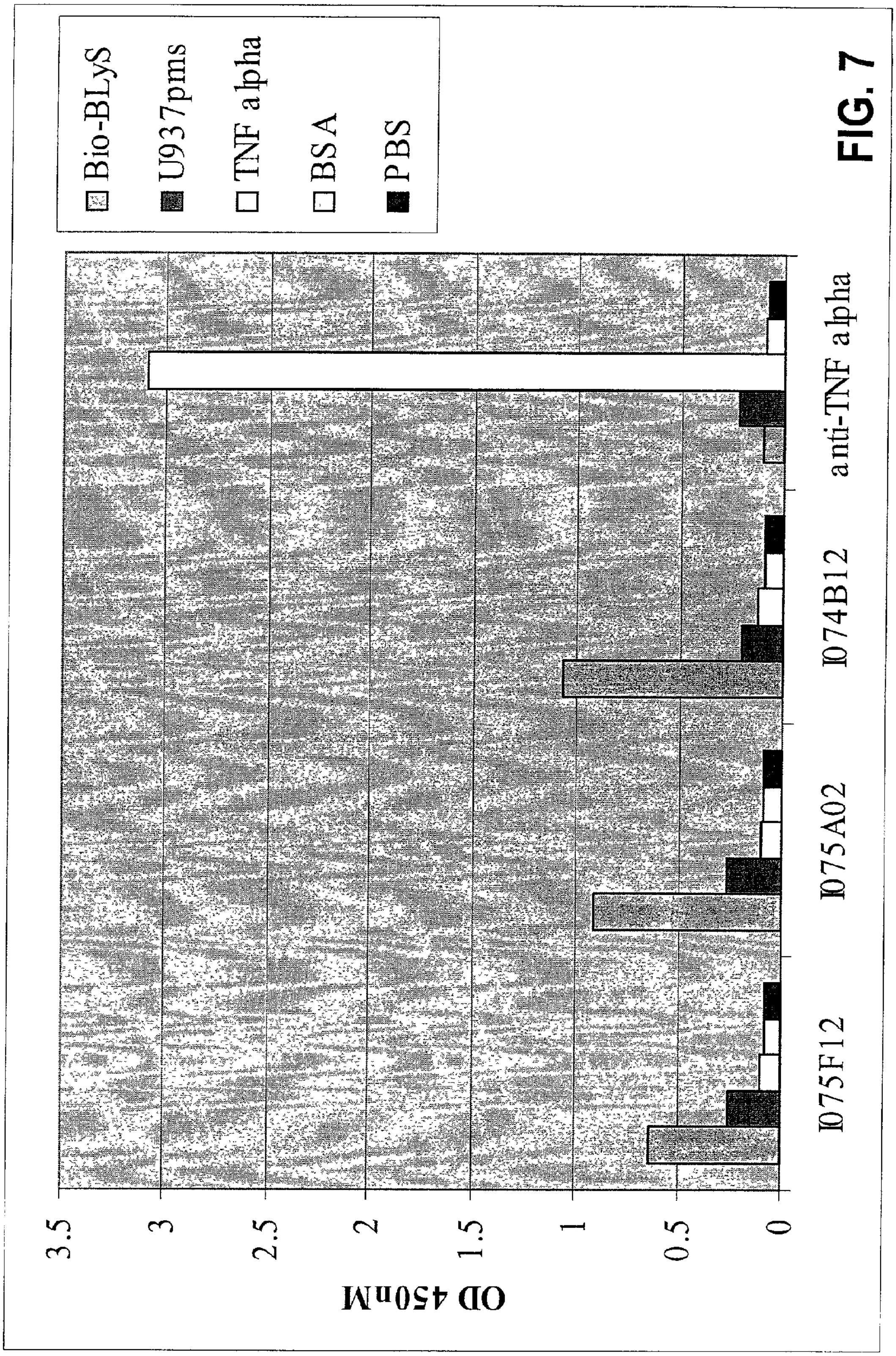
FIG. 7. ELISA results for three scFvs clones (I074B12, I075F12 and I075A02) that immunospecifically bind to immobilized B Lymphocyte Stimulator, but not to U937 plasma membranes, TNF-alpha or BSA. As a control, a phage antibody that recognizes TNFα, is also shown in FIG. 7.

As a control, a phage antibody that recognizes TNFα, is also shown in FIG. 7.

Figure 10:
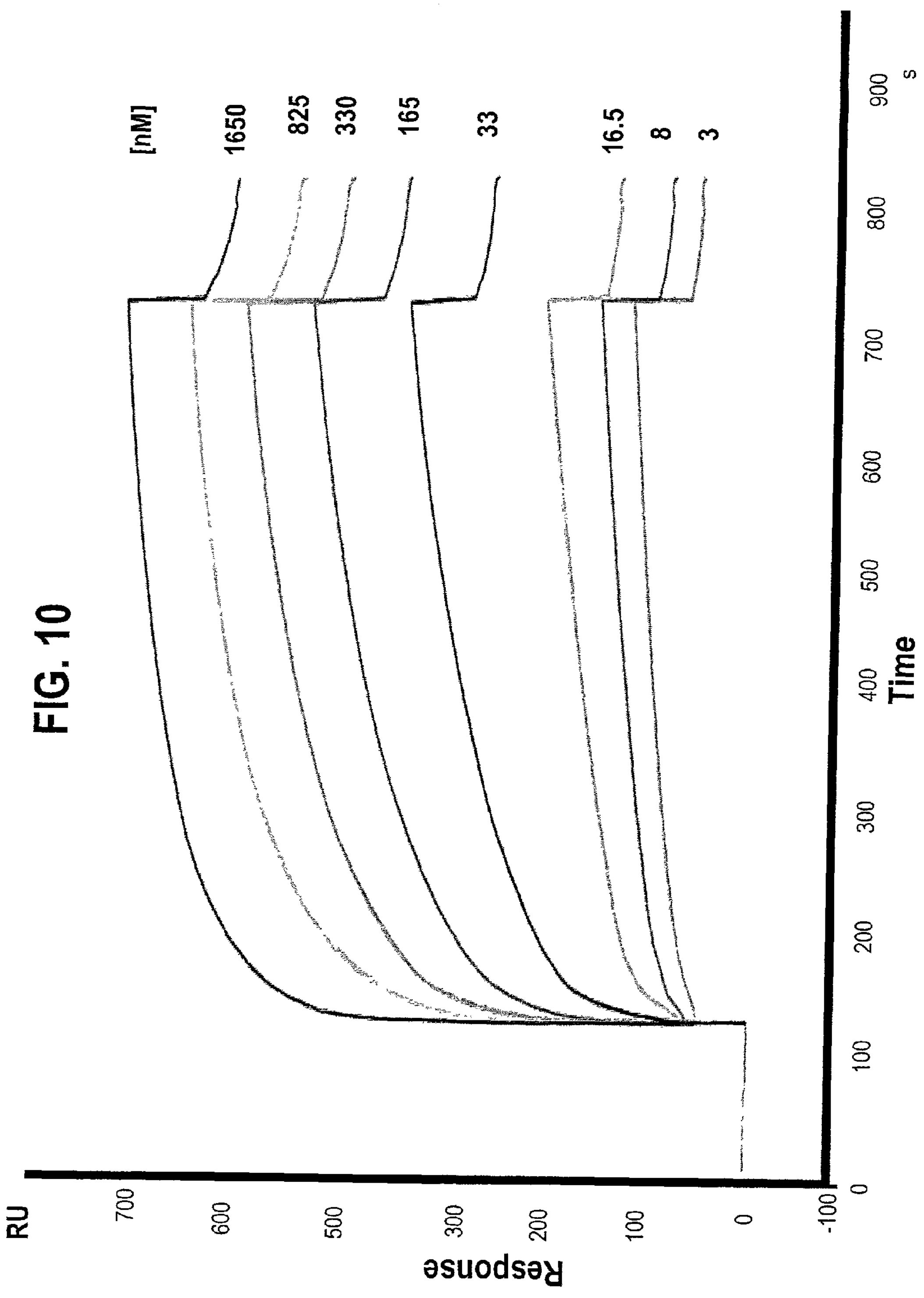

FIG. 10. Kinetic analysis of scFV antibody I002A01. A dilution series of I002A01 from 3 nM to 1650 nM is shown. Association and dissociation curves were generated using a BIAcore 2000 and BIAevaluation 3.0 software.

Figure 11:
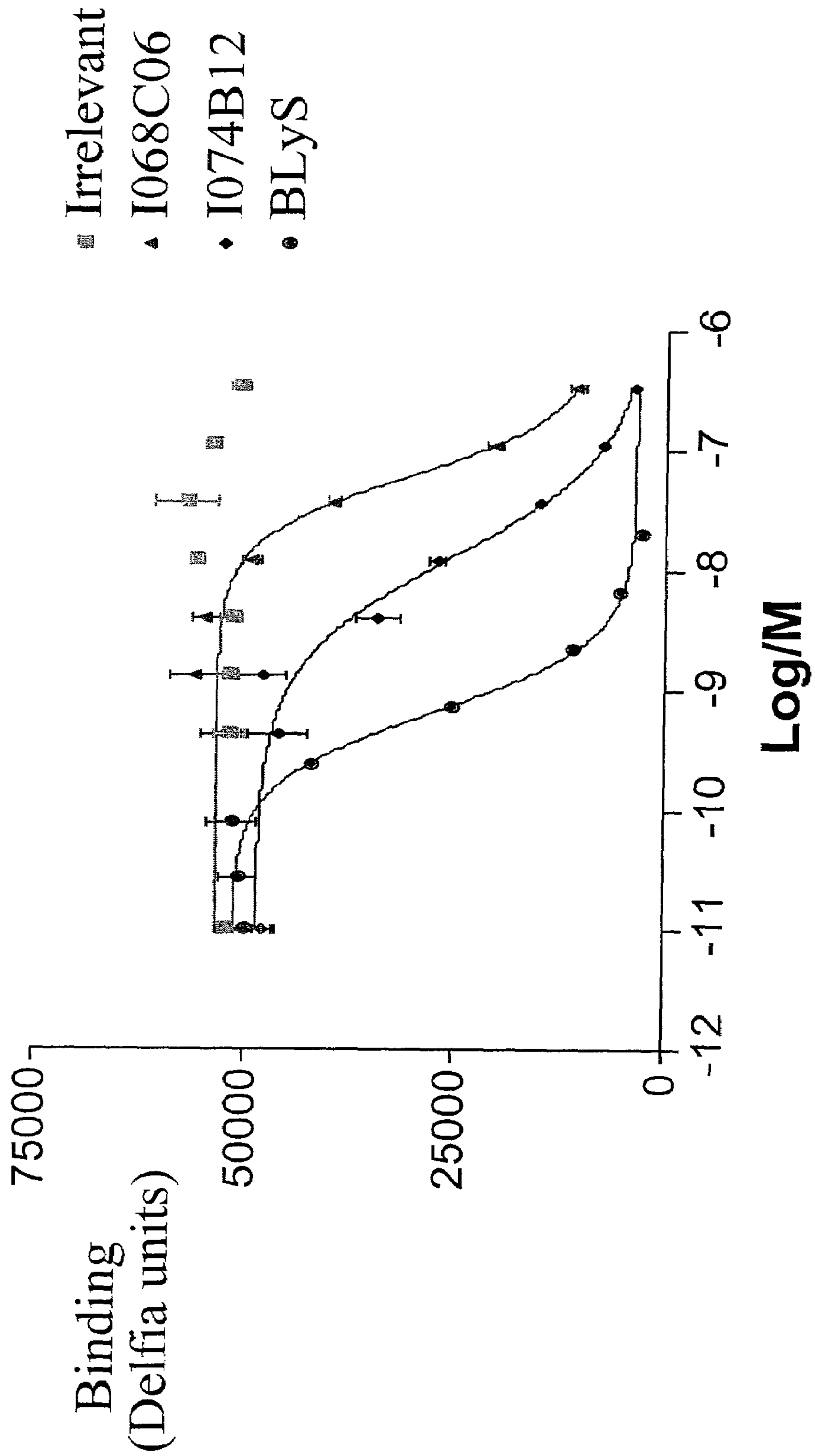

FIG. 11. Typical titration curves for two scFvs, I0068C06 and I074B12, are shown in FIG. 11. Unlabelled B Lymphocyte Stimulator competed for binding to its receptor with an inhibitory constant 50 ($IC_{50}$) value of 0.66 nM. The $IC_{50}$ values for I0068C06 and I074B12 are 61 nM and 13 nM, respectively. The assay was performed in triplicate and standard error bars are shown.

Figure 12:
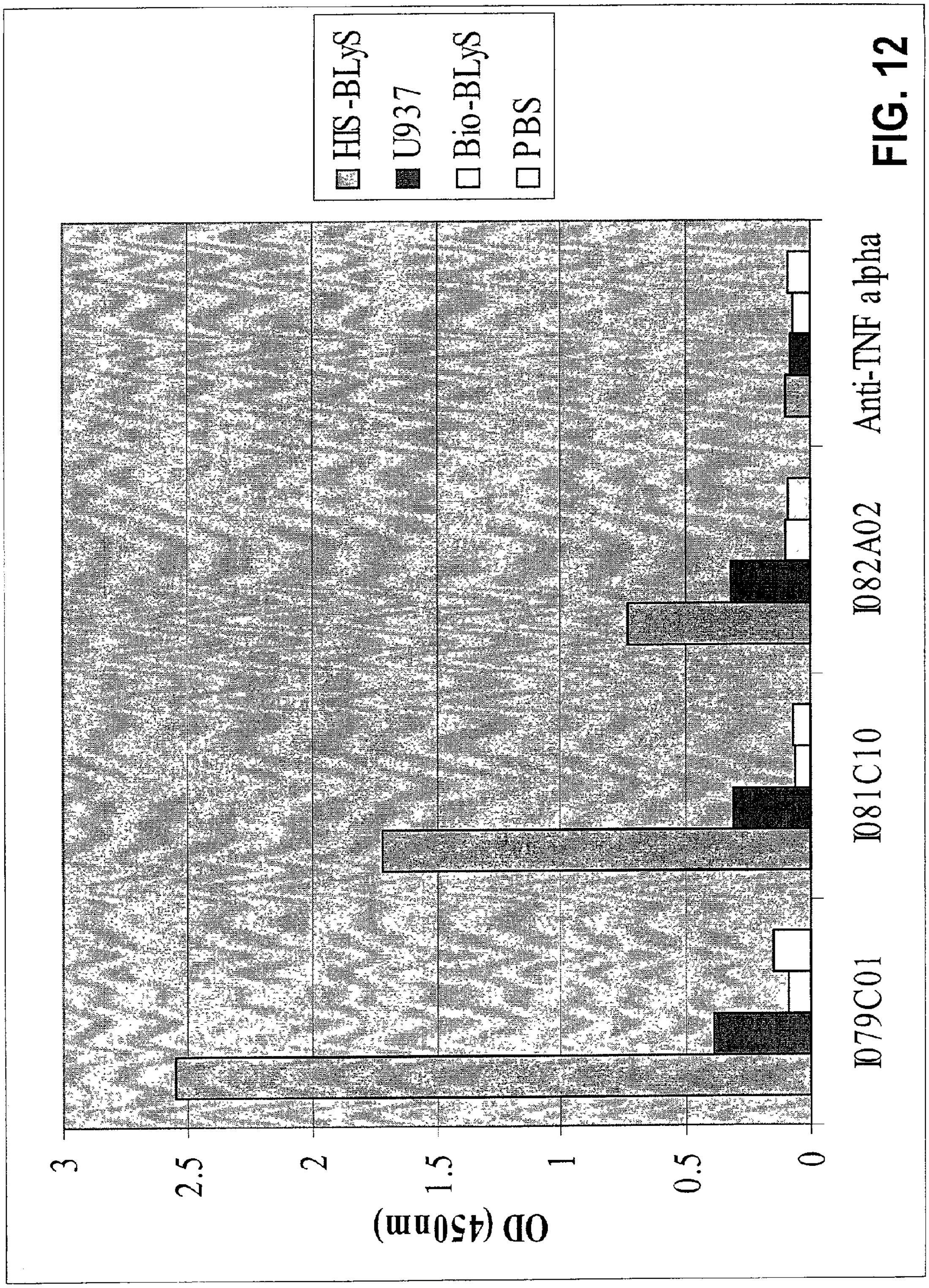

FIG. 12. ELISA results for three clones (I079C01, I081C10 and I082A02) demonstrating their ability to bind histidine-tagged B Lymphocyte Stimulator, U937 plasma membranes, but not to bind immobilized biotinylated B Lymphocyte Stimulator.

Figure 13:
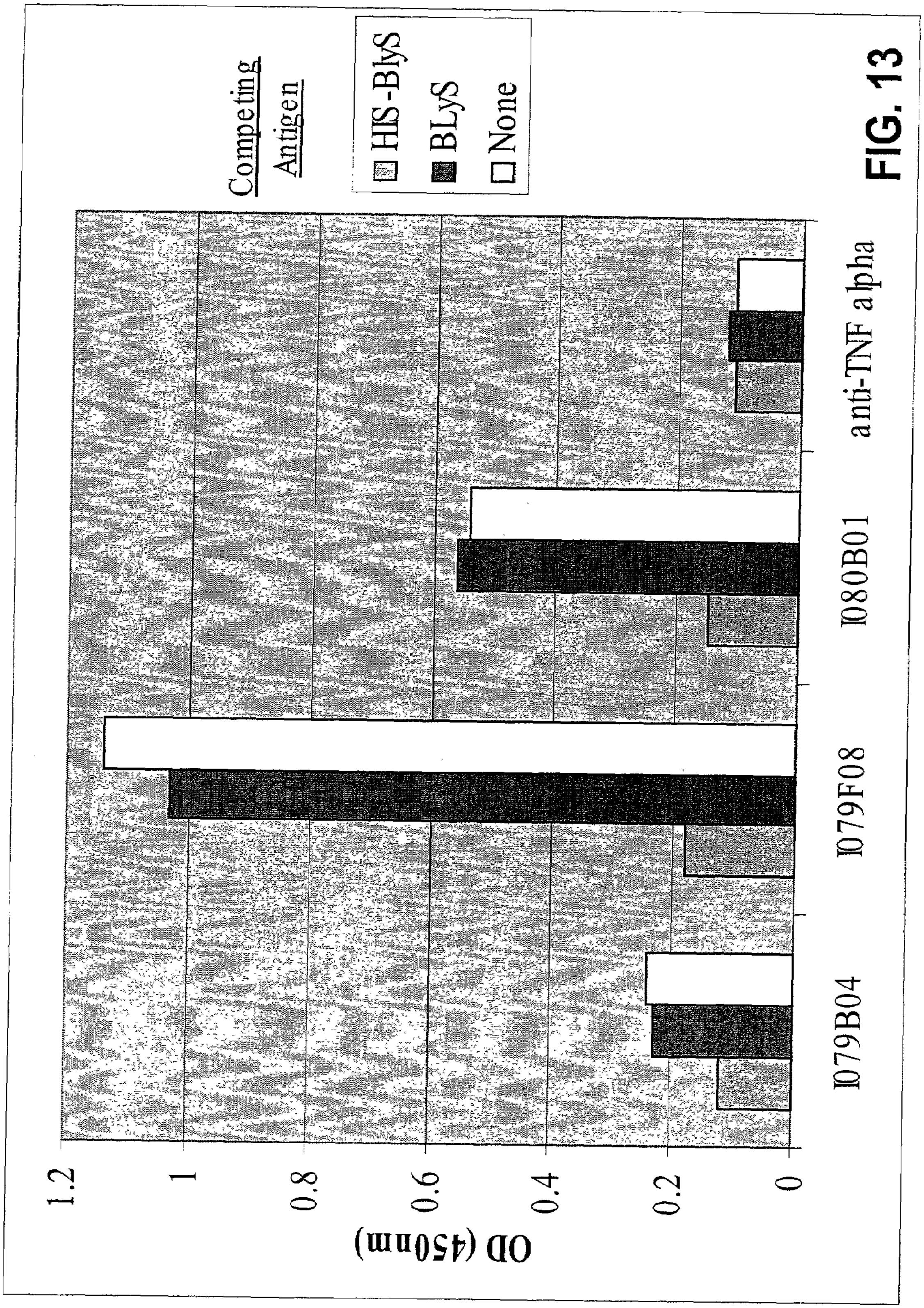

FIG. 13. ELISA results for three scFvs (I079B04, I079F08, and I080B01) binding to U937 plasma membranes when either histidine-tagged B Lymphocyte Stimulator or biotinylated B Lymphocyte Stimulator is used as a competitor.

Figure 14:
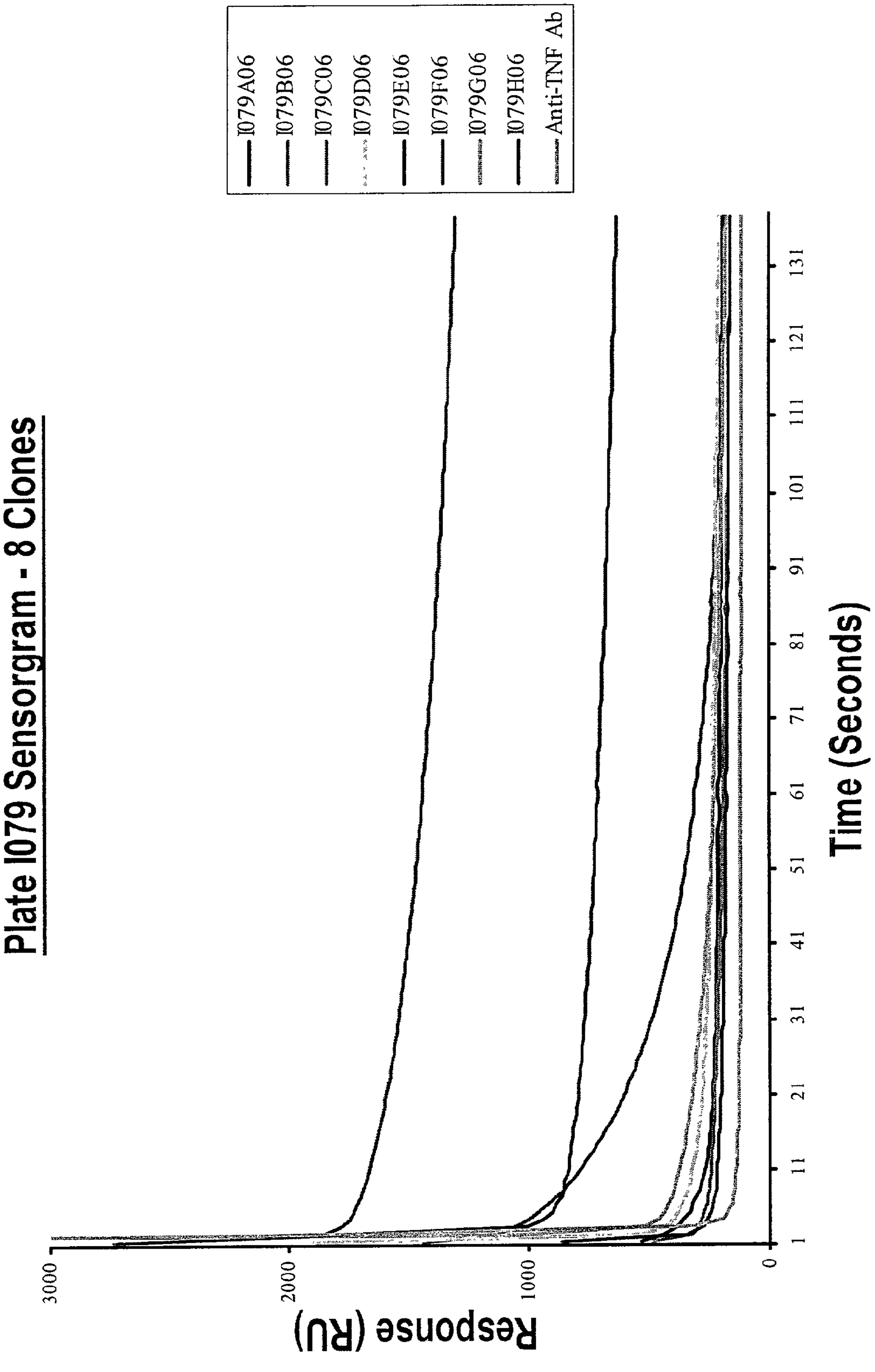

FIG. 14. An example of the dissociation section of a typical sensorgram for 8 scFvs is shown in FIG. 14. An anti-TNFα antibody that does not recognize B Lymphocyte Stimulator was included as a control. Of the 8 scFvs exemplified, I079F06 was identified for further study due to the relatively high numbers of RU's bound to the surface.

Figure 15:
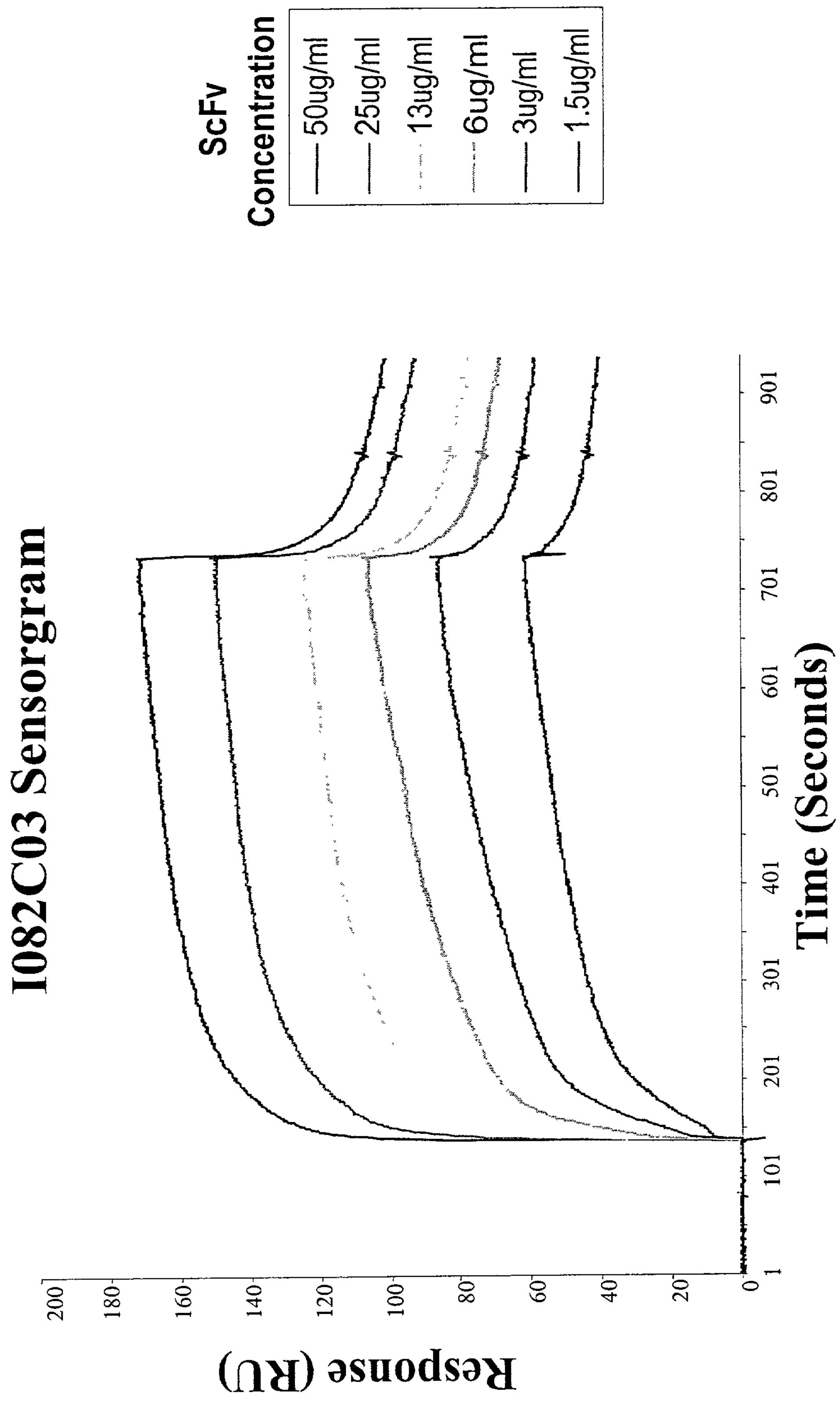

FIG. 15. A typical example of the binding curves generated for the scFv antibody I082C03 is shown in FIG. 15. The off-rate for this clone was calculated as $2\times10^{-3}$ $s^{-1}$. The affinity of I082C03 was calculated as 20 nM, assuming 100% activity of the scFv.

Figure 16:
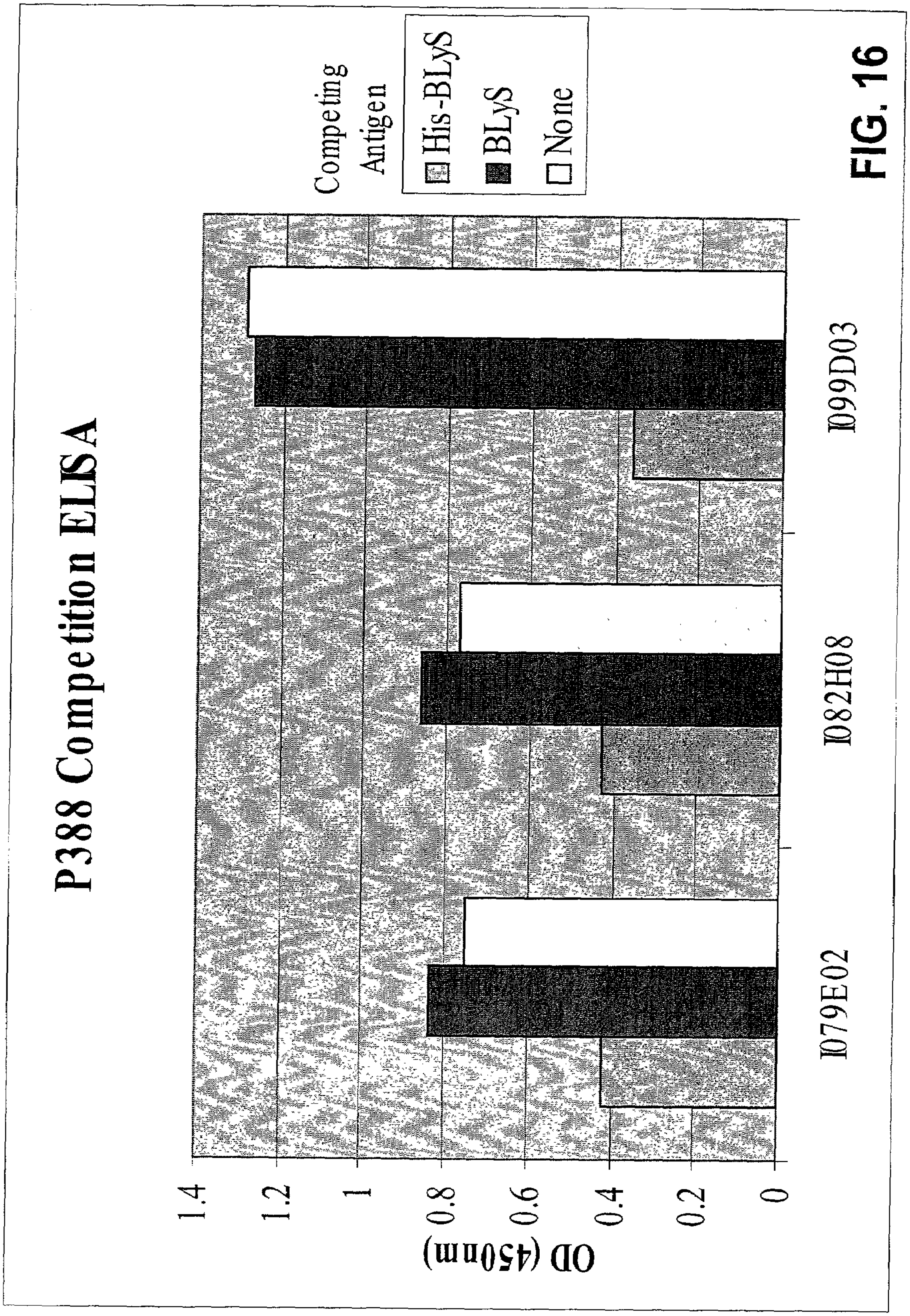

FIG. 16. ELISA results for three scFvs (I079B04, I079F08, and I080B01) binding to P388 plasma membranes when either histidine-tagged B Lymphocyte Stimulator or biotinylated B Lymphocyte Stimulator is used as a competitor.

DETAILED DESCRIPTION OF THE INVENTION

The present invention encompasses antibodies (including molecules comprising, or alternatively consisting of, antibody fragments or variants thereof) that immunospecifically bind to B Lymphocyte Stimulator or a fragment or variant of B Lymphocyte Stimulator. In particular, the invention provides antibodies such as, for example, single chain Fvs (scFvs) having an amino acid sequence of any one of SEQ ID NOS:1–2128, as referred to in Table 1. In particular, the present invention encompasses antibodies that immunospecifically bind to a polypeptide, a polypeptide fragment or variant, or an epitope of human B Lymphocyte Stimulator (SEQ ID NOS:3228 and/or 3229) or B Lymphocyte Stimulator expressed on human monocytes; murine B Lymphocyte Stimulator (SEQ ID NOS:3230 and/or 3231) or B Lymphocyte Stimulator expressed on murine monocytes; rat B Lymphocyte Stimulator (either the soluble forms as given in SEQ ID NOS:3232, 3233, 3234 and/or 3235 or in a membrane associated form, e.g., on the surface of rat monocytes); or monkey B Lymphocyte Stimulator (e.g., the monkey B Lymphocyte Stimulator polypeptides of SEQ ID NOS:3236 and/or 3237, the soluble form of monkey B Lymphocyte Stimulator, or B Lymphocyte Stimulator expressed on monkey monocytes) (as determined by immunoassays known in the art for assaying specific antibody-antigen binding).

The polypeptide sequence shown in SEQ ID NO:3228 was obtained by sequencing and translating the cDNA of the HNEDU15 clone which was deposited on Oct. 22, 1996 at the American Type Culture Collection, 10801 University Boulevard, Manassas, Va. 20110-2209, and assigned ATCC™ Accession No. 97768. The deposited clone is contained in the pBluescript SK(−) plasmid (Stratagene, La Jolla, Calif.). The ATCC™ deposits were made pursuant to the terms of the Budapest Treaty on the international recognition of the deposit of microorganisms for the purposes of patent procedure.

The polypeptide sequence shown in SEQ ID NO:3229 was obtained by sequencing and translating the cDNA of the HDPMC52 clone, which was deposited on Dec. 10, 1998 at the American Type Culture Collection, and assigned ATCC™ Accession No. 203518. The deposited clone is contained in the pBluescript SK(−) plasmid (Stratagene, La Jolla, Calif.). The ATCC™ deposits were made pursuant to the terms of the Budapest Treaty on the international recognition of the deposit of microorganisms for the purposes of patent procedure.

The B Lymphocyte Stimulator polypeptides bound by the antibodies of the invention may be in monomers or multimers (i.e., dimers, trimers, tetramers and higher multimers). Accordingly, the present invention relates to antibodies that bind monomers and multimers of the B Lymphocyte Stimulator polypeptides of the invention, their preparation, and compositions (preferably, pharmaceutical compositions) containing them. In specific embodiments, the antibodies of the invention bind B Lymphocyte Stimulator monomers, dimers, trimers or tetramers. In additional embodiments, the antibodies of the invention bind at least dimers, at least trimers, or at least tetramers of B Lymphocyte Stimulator.

Multimeric B Lymphocyte Stimulator bound by the antibodies of the invention may be homomers or heteromers. A B Lymphocyte Stimulator homomer, refers to a multimer containing only B Lymphocyte Stimulator polypeptides (including B Lymphocyte Stimulator fragments, variants, and fusion proteins, as described herein). These homomers may contain B Lymphocyte Stimulator polypeptides having identical or different amino acid sequences. In specific embodiments, the antibodies of the invention bind a B Lymphocyte Stimulator homodimer (e.g., containing two B Lymphocyte Stimulator polypeptides having identical or different amino acid sequences) or a B Lymphocyte Stimulator homotrimer (e.g., containing three B Lymphocyte Stimulator polypeptides having identical or different amino acid sequences). In a preferred embodiment, the antibodies of the invention bind homotrimers of B Lymphocyte Stimulator. In additional embodiments, the antibodies of the invention bind a homomeric B Lymphocyte Stimulator multimer which is at least a homodimer, at least a homotrimer, or at least a homotetramer.

Heteromeric B Lymphocyte Stimulator refers to a multimer containing heterologous polypeptides (i.e., polypeptides of a different protein) in addition to the B Lymphocyte Stimulator polypeptides of the invention. In a specific embodiment, the antibodies of the invention bind a B Lymphocyte Stimulator heterodimer, a heterotrimer, or a heterotetramer. In additional embodiments, the antibodies of the invention bind a heteromeric B Lymphocyte Stimulator multimer which is at least a heterodimer, at least a heterotrimer, or at least a heterotetramer. In highly preferred embodiments, the antibodies of the invention bind a heterotrimer comprising both B Lymphocyte Stimulator polypeptides and APRIL polypeptides (SEQ ID NO:3239; GenBank Accession No. AF046888; PCT International Publication Number WO97/33902; J. Exp. Med. 188(6):1185–1190) or fragments or variants thereof. In other highly preferred embodiments, the antibodies of the invention bind a heterotrimer comprising one B Lymphocyte Stimulator polypeptide (including fragments or variants) and two APRIL polypeptides (including fragments or variants). In still other highly preferred embodiments, the antibodies of the invention bind a heterotrimer comprising two B Lymphocyte Stimulator polypeptides (including fragments or variants) and one APRIL polypeptide (including fragments or variants). In a further nonexclusive embodiment, the heteromers bound by the antibodies of the invention contain CD40 ligand polypeptide sequence(s), or biologically active fragment(s) or variant(s) thereof.

In particularly preferred embodiments, the antibodies of the invention bind homomeric, especially homotrimeric, B Lymphocyte Stimulator polypeptides, wherein the individual protein components of the multimers consist of the mature form of B Lymphocyte Stimulator (e.g., amino acids residues 134–285 of SEQ ID NO:3228, or amino acids residues 134–266 of SEQ ID NO:3229) or fragments or variants thereof. In other specific embodiments, antibodies of the invention bind heteromeric, especially heterotrimeric, B Lymphocyte Stimulator polypeptides such as a heterotrimer containing two B Lymphocyte Stimulator polypeptides and one APRIL polypeptide or a heterotrimer containing one B Lymphocyte Stimulator polypeptide and two APRIL polypeptides, and wherein the individual protein components of the B Lymphocyte Stimulator heteromer consist of the mature extracellular soluble portion of either B Lymphocyte Stimulator (e.g., amino acids residues 134–285 of SEQ ID NO:3228, or amino acids residues 134–266 of SEQ ID NO:3229) or fragments or variants thereof, or the mature extracellular soluble portion APRIL (e.g., amino acid residues 105–250 of SEQ ID NO:3239) or fragments or variants thereof.

In specific embodiments, the antibodies of the invention bind conformational epitopes of a B Lymphocyte Stimulator monomeric protein. In specific embodiments, the antibodies of the invention bind conformational epitopes of a B Lymphocyte Stimulator multimeric, especially trimeric, protein. In other embodiments, antibodies of the invention bind conformational epitopes that arise from the juxtaposition of B Lymphocyte Stimulator with a heterologous polypeptide, such as might be present when B Lymphocyte Stimulator forms heterotrimers (e.g., with APRIL polypeptides (e.g., SEQ ID SEQ ID NO:3239)), or in fusion proteins between B Lymphocyte Stimulator and a heterologous polypeptide.

B Lymphocyte Stimulator multimers bound by the antibodies of the invention may be the result of hydrophobic, hydrophilic, ionic and/or covalent associations and/or may be indirectly linked, by for example, liposome formation. Thus, in one embodiment, B Lymphocyte Stimulator multimers, such as, for example, homodimers or homotrimers, are formed when polypeptides of the invention contact one another in solution. In another embodiment, B Lymphocyte Stimulator heteromultimers, such as, for example, B Lymphocyte Stimulator heterotrimers or B Lymphocyte Stimulator heterotetramers, are formed when polypeptides of the invention contact antibodies to the polypeptides of the invention (including antibodies to the heterologous polypeptide sequence in a fusion protein of the invention) in solution. In other embodiments, B Lymphocyte Stimulator multimers are formed by covalent associations with and/or between the B Lymphocyte Stimulator polypeptides of the invention. Such covalent associations may involve one or more amino acid residues contained in the polypeptide sequence (e.g., that recited in SEQ ID NO:3228 or SEQ ID NO:3229). In one instance, the covalent associations are cross-linking between cysteine residues located within the polypeptide sequences which interact in the native (i.e., naturally occurring) polypeptide. In another instance, the covalent associations are the consequence of chemical or recombinant manipulation. Alternatively, such covalent associations may involve one or more amino acid residues contained in the heterologous polypeptide sequence in a B Lymphocyte Stimulator fusion protein. In one example, covalent associations are between the heterologous sequence contained in a fusion protein (see, e.g., U.S. Pat. No. 5,478,925). In a specific example, the covalent associations are between the heterologous sequence contained in a B Lymphocyte Stimulator-Fc fusion protein. In another specific example, covalent associations of fusion proteins of the invention are between heterologous polypeptide sequence from another TNF family ligand/receptor member that is capable of forming covalently associated multimers, such as for example, oseteoprotegerin (see, e.g., International Publication No. WO 98/49305, the contents of which are herein incorporated by reference in its entirety). In another specific example, covalent associations of fusion proteins of the invention are between heterologous polypeptide sequence from CD40L, or a soluble fragment thereof. In another embodiment, two or B Lymphocyte Stimulator polypeptides are joined through synthetic linkers (e.g., peptide, carbohydrate or soluble polymer linkers). Examples include those peptide linkers described in U.S. Pat. No. 5,073,627 (hereby incorporated by reference). Proteins comprising multiple B Lymphocyte Stimulator polypeptides separated by peptide linkers may be produced using conventional recombinant DNA technology.

In one embodiment, antibodies of the invention immunospecifically bind a B Lymphocyte Stimulator polypeptide having the amino acid sequence of SEQ ID NO:3228 or as encoded by the cDNA clone contained in ATCC™ No. 97768, or a polypeptide comprising a portion (i.e., a fragment) of the above polypeptides. In another embodiment, the invention provides an antibody that binds an isolated B Lymphocyte Stimulator polypeptide having the amino acid sequence of SEQ ID NO:3229 or the amino acid sequence encoded by the cDNA clone contained in ATCC™ No. 203518, or a an antibody that binds polypeptide comprising a portion (i.e, fragment) of the above polypeptides.

Antibodies of the present invention immunospecifically bind to polypeptides comprising or alternatively, consisting of, the amino acid sequence of SEQ ID NO:3228, encoded by the cDNA contained in the plasmid having ATCC™ accession number 97768, or encoded by nucleic acids which hybridize (e.g., under stringent hybridization conditions) to the nucleotide sequence contained in the deposited clone. Antibodies of the present invention also bind to fragments of the amino acid sequence of SEQ ID NO:3228, encoded by the cDNA contained in the plasmid having ATCC™ accession number 97768, or encoded by nucleic acids which hybridize (e.g., under stringent hybridization conditions) to the nucleotide sequence contained in the deposited clone.

Additionally, antibodies of the present invention bind polypeptides comprising or alternatively, consisting of, the amino acid sequence of SEQ ID NO:3229, encoded by the cDNA contained in the plasmid having ATCC™ accession number 203518, or encoded by nucleic acids which hybridize (e.g., under stringent hybridization conditions) to the nucleotide sequence contained in the deposited clone. Antibodies of the present invention also bind to fragments of the amino acid sequence of SEQ ID NO:3229, encoded by the cDNA contained in the plasmid having ATCC™ accession number 203518, or encoded by nucleic acids which hybridize (e.g., under stringent hybridization conditions) to the nucleotide sequence contained in the deposited clone.

In addition, antibodies of the invention bind polypeptides or polypeptide fragments comprising or alternatively, consisting of, an amino acid sequence contained in SEQ ID NOS: 3230 through 3237.

In specific embodiments, the antibodies of the present invention immunospecifically bind polypeptide fragments including polypeptides comprising or alternatively, consisting of, an amino acid sequence contained in SEQ ID NO:3228, encoded by the cDNA contained in the deposited clone, or encoded by nucleic acids which hybridize (e.g., under stringent hybridization conditions) to the nucleotide sequence contained in the deposited clone. Protein fragments may be "free-standing," or comprised within a larger polypeptide of which the fragment forms a part or region, most preferably as a single continuous region. Representative examples of polypeptide fragments that may be bound by the antibodies of the present invention, include, for example, fragments that comprise or alternatively, consist of from about amino acid residues: 1 to 50, 51 to 100, 101 to 150, 151 to 200, 201 to 250, and/or 251 to 285 of SEQ ID NO:3228. Moreover, polypeptide fragments can be at least 10, 20, 30, 40, 50, 60, 70, 80, 90, 100, 110, 120, 130, 140, 150, 175 or 200 amino acids in length.

In specific embodiments, antibodies of the present invention bind polypeptide fragments comprising, or alternatively consisting of, amino acid residues: 1–46, 31–44, 47–72, 73–285, 73–83, 94–102, 148–152, 166–181, 185–209, 210–221, 226–237, 244–249, 253–265, and/or 277–285 of SEQ ID NO:3228.

It will be recognized by one of ordinary skill in the art that mutations targeted to regions of a B Lymphocyte Stimulator polypeptide of SEQ ID NO:3228 which encompass the nineteen amino acid residue insertion which is not found in the B Lymphocyte Stimulator polypeptide sequence of SEQ ID NO:3229 (i.e., amino acid residues Val-142 through Lys-160 of the sequence of SEQ ID NO:3229) may affect the observed biological activities of the B Lymphocyte Stimulator polypeptide. More specifically, a partial, non-limiting and non-exclusive list of such residues of the B Lymphocyte Stimulator polypeptide sequence which may be targeted for mutation includes the following amino acid residues of the B Lymphocyte Stimulator polypeptide sequence as shown in SEQ ID NO:3228: V-142; T-143; Q-144; D-145; C-146; L-147; Q-148; L-149; I-150; A-151; D-152; S-153; E-154; T-155; P-156; T-157; I-158; Q-159; and K-160. Thus, in specific embodiments, antibodies of the present invention that bind B Lymphocyte Stimulator polypeptides which have one or more mutations in the region from V-142 through K-160 of SEQ ID NO:3228 are contemplated.

Polypeptide fragments may be "free-standing," or comprised within a larger polypeptide of which the fragment forms a part or region, most preferably as a single continuous region. Representative examples of polypeptide fragments that may be bound by antibodies of the present invention, include, for example, fragments that comprise or alternatively, consist of from about amino acid residues: 1 to 15, 16–30, 31–46, 47–55, 56–72, 73–104, 105–163, 163–188, 186–210 and 210–284 of the amino acid sequence disclosed in SEQ ID NO:3228. Additional representative examples of polypeptide fragments that may be bound by antibodies of the present invention, include, for example, fragments that comprise or alternatively, consist of from about amino acid residues: 1 to 143, 1–150, 47–143, 47–150, 73–143, 73–150, 100–150, 140–145, 142–148, 140–150, 140–200, 140–225, and 140–266 of the amino acid sequence disclosed in SEQ ID NO:3229. Moreover, polypeptide fragments that may be bound by antibodies of the present invention, can be at least 10, 20, 30, 40, 50, 60, 70, 80, 90, 100, 110, 120, 130, 140, 150, 175 or 200 amino acids in length. In this context, "about" means the particularly recited ranges and ranges larger or smaller by several, a few, 5, 4, 3, 2 or 1 amino acid residues at either or both the amino- and carboxy-termini.

Additional preferred embodiments encompass antibodies that bind polypeptide fragments comprising, or alternatively consisting of, the predicted intracellular domain of B Lymphocyte Stimulator (e.g., amino acid residues 1–46 of SEQ ID NO:3228), the predicted transmembrane domain of B Lymphocyte Stimulator (e.g., amino acid residues 47–72 of SEQ ID NO:3228), the predicted extracellular domain of B Lymphocyte Stimulator (e.g., amino acid residues 73–285 of SEQ ID NO:3228), the mature soluble extracellular domain of B Lymphocyte Stimulator (e.g., amino acids residues 134–285 of SEQ ID NO:3228), the predicted TNF conserved domain of B Lymphocyte Stimulator (e.g., amino acids 191 to 284 of SEQ ID NO:3228), and a polypeptide comprising, or alternatively, consisting of the predicted intracellular domain fused to the predicted extracellular domain of B Lymphocyte Stimulator (amino acid residues 1–46 fused to amino acid residues 73–285 of SEQ ID NO:3228).

Further additional preferred embodiments encompass polypeptide fragments comprising, or alternatively consisting of, the predicted intracellular domain of B Lymphocyte Stimulator (amino acid residues 1–46 of SEQ ID NO:3229), the predicted transmembrane domain of B Lymphocyte Stimulator (amino acid residues 47–72 of SEQ ID NO:3229), the predicted extracellular domain of B Lymphocyte Stimulator (amino acid residues 73–266 of SEQ ID NO:3229), the predicted TNF conserved domain of B Lymphocyte Stimulator (amino acids 172 to 265 of SEQ ID NO:3229), and a polypeptide comprising, or alternatively, consisting of the predicted intracellular domain fused to the predicted extracellular domain of B Lymphocyte Stimulator (amino acid residues 1–46 fused to amino acid residues 73–266 of SEQ ID NO:3229).

Certain additional embodiments of the invention encompass antibodies that bind polypeptide fragments comprising, or alternatively consisting of, the predicted beta-pleated sheet regions of the B Lymphocyte Stimulator polypeptides of SEQ ID NO:3228 and SEQ ID NO:3229. These polypeptide fragments comprising the beta-pleated sheets of B Lymphocyte Stimulator comprise, or alternatively consist of, amino acid residues Gln-144 to Ala-151, Phe-172 to Lys-173, Ala-177 to Glu-179, Asn-183 to Ile-185, Gly-191 to Lys-204, His-210 to Val-219, Leu-226 to Pro-237, Asn-242 to Ala-251, Gly-256 to Ile-263 and/or Val-276 to Leu-284 of SEQ ID NO:3228. In another, nonexclusive embodiment, these polypeptide fragments comprising the beta-pleated sheets of B Lymphocyte Stimulator comprise, or alternatively consist of, amino acid residues Phe-153 to Lys-154, Ala-158 to Glu-160, Asn-164 to Ile-166, Gly-172 to Lys-185, His-191 to Val-200, Leu-207 to Pro-218, Asn-223 to Ala-232, Gly-237 to Ile-244 and/or Val-257 to Leu-265 of SEQ ID NO:3229.

A partial, non-limiting, and exemplary list of polypeptides that may be bound by the antibodies of the invention includes polypeptides that comprise, or alternatively consist of, combinations of amino acid sequences of the invention includes, for example, [Met-1 to Lys-113] fused to [Leu-114 to Thr-141] fused to [Val-142 to Lys-160] fused to [Gly-161 to Gln-198] fused to [Val-199 to Ala-248] fused to [Gly-249 to Leu-285] of SEQ ID NO:3228; or [Met-1 to Lys-113] fused to [Val-142 to Lys-160] fused to [Gly-161 to Gln-198] fused to [Val-199 to Ala-248] fused to [Gly-249 to Leu-285] of SEQ ID NO:3228; or [Met-1 to Lys-113] fused to [Leu-114 to Thr-141] fused to [Val-142 to Lys-160] fused to [Gly-161 to Gln-198] fused to [Gly-249 to Leu-285] of SEQ ID NO:3228. Other combinations of amino acids sequences that may be bound by the antibodies of the invention may include the polypeptide fragments in an order other than that recited above (e.g., [Leu-114 to Thr-141] fused to [Val-199 to Ala-248] fused to [Gly-249 to Leu-285] fused to [Val-142 to Lys-160] of (SEQ ID NO:3228). Other combinations of amino acids sequences that may be bound by the antibodies of the invention may also include heterologous polypeptide fragments as described herein and/or other polypeptides or polypeptide fragments of the present invention (e.g., [Met-1 to Lys-113] fused to [Leu-14 to Thr-141] fused to [Val-142 to Lys-160] fused to [Gly-161 to Gln-198] fused to [Gly-249 to Leu-285] of SEQ ID NO:3228 fused to a FLAG tag; or [Met-1 to Lys-113] of SEQ ID NO:3228 fused to [Leu-114 to Thr-141] of SEQ ID NO:3228 fused to [Glu-135 to Asn-165] of SEQ ID NO:39 fused to [Val-142 to Lys-160] of SEQ ID NO:3228 fused to [Gly-161 to Gln-198] of SEQ ID NO:3228 fused to [Val-199 to Ala-248] of SEQ ID NO:3228 fused to [Gly-249 to Leu-285] of SEQ ID NO:3228).

A partial, non-limiting, and exemplary list of polypeptides that may be bound by the antibodies of the invention includes polypeptides that comprise, or alternatively consist of, combinations of amino acid sequences includes, for example, [Met-1 to Lys-113] fused to [Leu-114 to Thr-141] fused to [Gly-142 to Gln-179] fused to [Val-180 to Ala-229] fused to [Gly-230 to Leu-266] of SEQ ID NO:3229; [Met-1 to Lys-113] fused to [Gly-142 to Gln-179] fused to [Val-180 to Ala-229] fused to [Gly-230 to Leu-266] of SEQ ID NO:3229; or [Met-1 to Lys-113] fused to [Leu-114 to Thr-141] fused to [Gly-142 to Gln-179] fused to [Gly-230 to Leu-266] of SEQ ID NO:3229. Other of amino acids sequences that may be bound by the antibodies of the invention combinations may include the polypeptide fragments in an order other than that recited above (e.g., [Leu-114 to Thr-141] fused to [Val-180 to Ala-229] fused to [Gly-230 to Leu-266] fused to [Gly-142 to Gln-179] of SEQ ID NO:3229). Other combinations of amino acid sequences that may be bound by the antibodies of the invention may also include heterologous polypeptide fragments as described herein and/or other polypeptides or polypeptide fragments of the present invention (e.g., [Met-1 to Lys-113] fused to [Leu-114 to Thr-141] fused to [Gly-142 to Gln-179] fused to [Gly-230 to Leu-266] of SEQ ID NO:3229 fused to a FLAG tag (SEQ ID NO:3238) or, [Met-1 to Lys-113] of SEQ ID NO:3229 fused to [Leu-114 to Thr-141] of SEQ ID NO:3229 fused to [Glu-135 to Asn-165] of SEQ ID NO:39 fused to [Gly-142 to Gln-179] of SEQ ID NO:3229 fused to [Val-180 to Ala-229] of SEQ ID NO:3229 fused to [Gly-230 to Leu-266] of SEQ ID NO:3229.

Additional embodiments of the invention encompass antibodies that bind B Lymphocyte Stimulator polypeptide fragments comprising, or alternatively consisting of, functional regions of polypeptides of the invention, such as the Garnier-Robson alpha-regions, beta-regions, turn-regions, and coil-regions, Chou-Fasman alpha-regions, beta-regions, and coil-regions, Kyte-Doolittle hydrophilic regions and hydrophobic regions, Eisenberg alpha- and beta-amphipathic regions, Karplus-Schulz flexible regions, Emini surface-forming regions and Jameson-Wolf regions of high antigenic index set out in Tables 9 and 10 and as described herein. In a preferred embodiment, the polypeptide fragments bound by the antibodies of the invention are antigenic (i.e., containing four or more contiguous amino acids having an antigenic index of greater than or equal to 1.5, as identified using the default parameters of the Jameson-Wolf program) of a complete (i.e., full-length) B Lymphocyte Stimulator polypeptide (e.g., SEQ ID NOS:3228 and 3229).

The data representing the structural or functional attributes of the B Lymphocyte Stimulator polypeptide of SEQ ID NO:3228 (Table 9) or the B Lymphocyte Stimulator polypeptide of SEQ ID NO:3229 (Table 10), as described above, was generated using the various modules and algorithms of the DNA*STAR set on default parameters. Column I represents the results of a Garnier-Robson analysis of alpha helical regions; Column II represents the results of a Chou-Fasman analysis of alpha helical regions; Column III represents the results of a Garnier Robson analysis of beta sheet regions; Column IV represents the results of a Chou-Fasman analysis of beta sheet regions; Column V represents the results of a Garnier Robson analysis of turn regions; Column VI represents the results of a Chou-Fasman analysis of turn regions; Column VII represents the results of a Garnier Robson analysis of coil regions; Column VIII represents a Kyte-Doolittle hydrophilicity plot; Column IX represents a Hopp-Woods hydrophobicity plot; Column X represents the results of an Eisenberg analysis of alpha amphipathic regions; Column XI represents the results of an Eisenberg analysis of beta amphipathic regions; Column XII represents the results of a Karplus-Schultz analysis of flexible regions; Column XIII represents the Jameson-Wolf antigenic index score; and Column XIV represents the Emini surface probability plot.

In a preferred embodiment, the data presented in columns VIII, IX, XIII, and XIV of Tables 9 and 10 can be used to determine regions of the B Lymphocyte Stimulator polypeptide of SEQ ID NO:3228 (Table 9) or the B Lymphocyte Stimulator polypeptide of SEQ ID NO:3229 (Table 10) which exhibit a high degree of potential for antigenicity. Regions of high antigenicity are determined from the data presented in columns VIII, IX, XIII, and/or XIV by choosing values which represent regions of the polypeptide which are likely to be exposed on the surface of the polypeptide in an environment in which antigen recognition may occur in the process of initiation of an immune response.

The above-mentioned preferred regions set out in Tables 9 and 10 include, but are not limited to, regions of the aforementioned types identified by analysis of the amino acid sequence set out in SEQ ID NO:2. As set out in Tables 9 and 10, such preferred regions include Garnier-Robson alpha-regions, beta-regions, turn-regions, and coil-regions, Chou-Fasman alpha-regions, beta-regions, and turn-regions, Kyte-Doolittle hydrophilic regions, Eisenberg alpha- and beta-amphipathic regions, Karplus-Schulz flexible regions, Jameson-Wolf regions of high antigenic index and Emini surface-forming regions. Preferably, antibodies of the present invention bind B Lymphocyte Stimulator polypeptides or B Lymphocyte Stimulator polypeptide fragments and variants comprising regions of B Lymphocyte Stimulator that combine several structural features, such as several (e.g., 1, 2, 3, or 4) of the same or different region features set out above and in Tables 9 and 10.

TABLE 9

| Res | Position | I | II | III | IV | V | VI | VII | VIII | IX | X | XI | XII | XIII | XIV |
|---|---|---|---|---|---|---|---|---|---|---|---|---|---|---|---|
| Met | 1 | A | . | . | . | . | . | . | 0.73 | −0.71 | . | . | . | 0.95 | 1.39 |
| Asp | 2 | A | . | . | . | . | T | . | 1.12 | −0.66 | * | . | . | 1.15 | 1.56 |
| Asp | 3 | A | . | . | . | . | T | . | 1.62 | −1.09 | * | . | . | 1.15 | 2.12 |
| Ser | 4 | A | . | . | . | . | T | . | 2.01 | −1.51 | . | . | . | 1.15 | 4.19 |
| Thr | 5 | A | . | . | . | . | T | . | 2.40 | −2.13 | . | . | F | 1.30 | 4.35 |
| Glu | 6 | A | A | . | . | . | . | . | 2.70 | −1.73 | * | * | F | 0.90 | 4.51 |
| Arg | 7 | A | A | . | . | . | . | . | 2.81 | −1.34 | * | * | F | 0.90 | 4.51 |
| Glu | 8 | A | A | . | . | . | . | . | 2.00 | −1.73 | * | * | F | 0.90 | 6.12 |
| Gln | 9 | A | A | . | . | . | . | . | 1.99 | −1.53 | * | * | F | 0.90 | 2.91 |
| Ser | 10 | A | . | . | B | . | . | . | 2.00 | −1.04 | * | * | F | 0.90 | 2.15 |
| Arg | 11 | A | . | . | B | . | . | . | 1.33 | −0.66 | * | * | F | 0.90 | 1.66 |
| Leu | 12 | A | . | . | B | . | . | . | 0.41 | −0.09 | * | * | F | 0.45 | 0.51 |
| Thr | 13 | A | . | . | B | . | . | . | 0.46 | 0.20 | * | * | F | −0.15 | 0.32 |
| Ser | 14 | A | A | . | . | . | . | . | 0.50 | −0.19 | * | * | . | 0.30 | 0.32 |
| Cys | 15 | A | A | . | . | . | . | . | 0.91 | −0.19 | * | * | . | 0.30 | 0.78 |
| Leu | 16 | A | A | . | . | . | . | . | 0.80 | −0.87 | * | * | F | 0.90 | 1.06 |
| Lys | 17 | A | A | . | . | . | . | . | 1.61 | −1.36 | . | * | F | 0.90 | 1.37 |
| Lys | 18 | A | A | . | . | . | . | . | 1.32 | −1.74 | . | * | F | 0.90 | 4.44 |
| Arg | 19 | A | A | . | . | . | . | . | 1.67 | −1.70 | . | * | F | 0.90 | 5.33 |
| Glu | 20 | A | A | . | . | . | . | . | 1.52 | −2.39 | . | * | F | 0.90 | 5.33 |

TABLE 9-continued

| Res | Position | I | II | III | IV | V | VI | VII | VIII | IX | X | XI | XII | XIII | XIV |
|---|---|---|---|---|---|---|---|---|---|---|---|---|---|---|---|
| Glu | 21 | A | A | . | . | . | . | . | 2.38 | −1.70 | . | * | F | 0.90 | 2.20 |
| Met | 22 | A | A | . | . | . | . | . | 2.33 | −1.70 | . | * | F | 0.90 | 2.24 |
| Lys | 23 | A | A | . | . | . | . | . | 1.62 | −1.70 | * | * | F | 0.90 | 2.24 |
| Leu | 24 | A | A | . | . | . | . | . | 0.66 | −1.13 | * | * | F | 0.75 | 0.69 |
| Lys | 25 | A | A | . | . | . | . | . | 0.36 | −0.49 | . | * | F | 0.45 | 0.52 |
| Glu | 26 | A | A | . | B | . | . | . | −0.53 | −0.71 | * | * | . | 0.60 | 0.35 |
| Cys | 27 | A | A | . | B | . | . | . | −0.74 | −0.03 | * | * | . | 0.30 | 0.30 |
| Val | 28 | A | A | . | B | . | . | . | −1.00 | −0.03 | * | * | . | 0.30 | 0.12 |
| Ser | 29 | A | A | . | B | . | . | . | −0.08 | 0.40 | * | * | . | −0.30 | 0.11 |
| Ile | 30 | A | . | . | B | . | . | . | −0.08 | 0.40 | * | * | . | −0.30 | 0.40 |
| Leu | 31 | A | . | . | B | . | . | . | −0.08 | −0.17 | * | . | . | 0.45 | 1.08 |
| Pro | 32 | . | . | . | B | . | . | C | 0.29 | −0.81 | * | . | F | 1.10 | 1.39 |
| Arg | 33 | . | . | . | . | T | . | . | 0.93 | −0.81 | . | * | F | 1.50 | 2.66 |
| Lys | 34 | . | . | . | . | T | . | . | 0.93 | −1.07 | . | . | F | 1.84 | 4.98 |
| Glu | 35 | . | . | . | . | . | . | C | 0.97 | −1.37 | * | * | F | 1.98 | 4.32 |
| Ser | 36 | . | . | . | . | . | T | C | 1.89 | −1.16 | * | * | F | 2.52 | 1.64 |
| Pro | 37 | . | . | . | . | . | T | C | 1.80 | −1.16 | * | * | F | 2.86 | 1.60 |
| Ser | 38 | . | . | . | . | T | T | . | 1.39 | −0.77 | * | . | F | 3.40 | 1.24 |
| Val | 39 | A | . | . | . | . | T | . | 1.39 | −0.39 | . | * | F | 2.36 | 1.24 |
| Arg | 40 | A | . | . | . | . | . | . | 1.39 | −0.77 | * | * | F | 2.46 | 1.60 |
| Ser | 41 | A | . | . | . | . | . | . | 1.34 | −1.20 | * | * | F | 2.46 | 2.00 |
| Ser | 42 | . | . | . | . | T | T | . | 1.60 | −1.16 | . | * | F | 3.06 | 2.67 |
| Lys | 43 | . | . | . | . | T | T | . | 1.09 | −1.80 | . | * | F | 3.06 | 2.72 |
| Asp | 44 | . | . | . | . | T | T | . | 1.13 | −1.11 | * | * | F | 3.40 | 1.67 |
| Gly | 45 | A | . | . | . | . | T | . | 0.43 | −0.81 | * | * | F | 2.66 | 1.03 |
| Lys | 46 | A | A | . | . | . | . | . | 0.14 | −0.70 | . | . | F | 1.77 | 0.52 |
| Leu | 47 | A | A | . | . | . | . | . | 0.13 | −0.20 | * | . | . | 0.98 | 0.31 |
| Leu | 48 | A | A | . | . | . | . | . | −0.72 | 0.29 | * | . | . | 0.04 | 0.46 |
| Ala | 49 | A | A | . | . | . | . | . | −1.53 | 0.54 | . | * | . | −0.60 | 0.19 |
| Ala | 50 | A | A | . | . | . | . | . | −2.00 | 1.23 | . | . | . | −0.60 | 0.19 |
| Thr | 51 | A | A | . | . | . | . | . | −2.63 | 1.23 | . | . | . | −0.60 | 0.19 |
| Leu | 52 | A | A | . | . | . | . | . | −2.63 | 1.04 | . | . | . | −0.60 | 0.19 |
| Leu | 53 | A | A | . | . | . | . | . | −2.63 | 1.23 | . | . | . | −0.60 | 0.15 |
| Leu | 54 | A | A | . | . | . | . | . | −2.34 | 1.41 | . | . | . | −0.60 | 0.09 |
| Ala | 55 | A | A | . | . | . | . | . | −2.42 | 1.31 | . | . | . | −0.60 | 0.14 |
| Leu | 56 | A | A | . | . | . | . | . | −2.78 | 1.20 | . | . | . | −0.60 | 0.09 |
| Leu | 57 | A | . | . | . | . | T | . | −2.78 | 1.09 | . | . | . | −0.20 | 0.06 |
| Ser | 58 | A | . | . | . | . | T | . | −2.28 | 1.09 | . | . | . | −0.20 | 0.05 |
| Cys | 59 | A | . | . | . | . | T | . | −2.32 | 1.07 | . | . | . | −0.20 | 0.09 |
| Cys | 60 | A | . | . | . | . | T | . | −2.59 | 1.03 | . | . | . | −0.20 | 0.08 |
| Leu | 61 | . | . | B | B | . | . | . | −2.08 | 0.99 | . | . | . | −0.60 | 0.04 |
| Thr | 62 | . | . | B | B | . | . | . | −1.97 | 0.99 | . | . | . | −0.60 | 0.11 |
| Val | 63 | . | . | B | B | . | . | . | −1.91 | 1.20 | . | . | . | −0.60 | 0.17 |
| Val | 64 | . | . | B | B | . | . | . | −1.24 | 1.39 | . | . | . | −0.60 | 0.33 |
| Ser | 65 | . | . | B | B | . | . | . | −1.43 | 1.10 | . | . | . | −0.60 | 0.40 |
| Phe | 66 | A | . | . | B | . | . | . | −1.21 | 1.26 | . | . | . | −0.60 | 0.40 |
| Tyr | 67 | A | . | . | B | . | . | . | −1.49 | 1.11 | . | . | . | −0.60 | 0.54 |
| Gln | 68 | A | . | . | B | . | . | . | −1.44 | 0.97 | . | . | . | −0.60 | 0.41 |
| Val | 69 | A | . | . | B | . | . | . | −0.59 | 1.27 | . | . | . | −0.60 | 0.39 |
| Ala | 70 | A | . | . | B | . | . | . | −0.63 | 0.89 | . | . | . | −0.60 | 0.43 |
| Ala | 71 | A | . | . | B | . | . | . | 0.07 | 0.56 | . | * | . | −0.60 | 0.25 |
| Leu | 72 | A | . | . | . | . | T | . | −0.50 | 0.16 | . | * | . | 0.10 | 0.55 |
| Gln | 73 | A | . | . | . | . | T | . | −1.09 | 0.20 | . | . | F | 0.25 | 0.45 |
| Gly | 74 | A | . | . | . | . | T | . | −0.53 | 0.20 | . | . | F | 0.25 | 0.45 |
| Asp | 75 | A | . | . | . | . | T | . | −0.76 | 0.09 | . | * | F | 0.25 | 0.73 |
| Leu | 76 | A | A | . | . | . | . | . | −0.06 | 0.09 | . | * | F | −0.15 | 0.35 |
| Ala | 77 | A | A | . | . | . | . | . | 0.17 | −0.31 | . | * | . | 0.30 | 0.69 |
| Ser | 78 | A | A | . | . | . | . | . | 0.17 | −0.24 | . | * | . | 0.30 | 0.42 |
| Leu | 79 | A | A | . | . | . | . | . | −0.30 | −0.24 | . | * | . | 0.30 | 0.88 |
| Arg | 80 | A | A | . | . | . | . | . | −0.30 | −0.24 | . | * | . | 0.30 | 0.72 |
| Ala | 81 | A | A | . | . | . | . | . | 0.17 | −0.34 | . | * | . | 0.30 | 0.93 |
| Glu | 82 | A | A | . | . | . | . | . | 0.72 | −0.30 | . | * | . | 0.45 | 1.11 |
| Leu | 83 | A | A | . | . | . | . | . | 0.99 | −0.49 | . | * | . | 0.30 | 0.77 |
| Gln | 84 | A | A | . | . | . | . | . | 1.21 | 0.01 | . | * | . | −0.15 | 1.04 |
| Gly | 85 | A | A | . | . | . | . | . | 1.10 | 0.01 | * | * | . | −0.30 | 0.61 |
| His | 86 | A | A | . | . | . | . | . | 1.73 | 0.01 | * | * | . | −0.15 | 1.27 |
| His | 87 | A | A | . | . | . | . | . | 0.92 | −0.67 | . | * | . | 0.75 | 1.47 |
| Ala | 88 | A | A | . | . | . | . | . | 1.52 | −0.39 | . | * | . | 0.45 | 1.22 |
| Glu | 89 | A | A | . | . | . | . | . | 0.93 | −0.39 | . | . | . | 0.45 | 1.39 |
| Lys | 90 | A | A | . | . | . | . | . | 0.93 | −0.39 | * | . | F | 0.60 | 1.03 |
| Leu | 91 | A | . | . | . | . | T | . | 0.38 | −0.46 | * | . | . | 0.85 | 1.01 |
| Pro | 92 | A | . | . | . | . | T | . | 0.07 | −0.46 | . | . | . | 0.70 | 0.59 |
| Ala | 93 | A | . | . | . | . | T | . | 0.07 | −0.03 | . | . | . | 0.70 | 0.29 |
| Gly | 94 | A | . | . | . | . | T | . | −0.14 | 0.47 | . | . | . | −0.20 | 0.36 |
| Ala | 95 | A | . | . | . | . | . | . | −0.14 | 0.21 | . | * | . | −0.10 | 0.36 |
| Gly | 96 | A | . | . | . | . | . | . | 0.08 | −0.21 | . | . | F | 0.65 | 0.71 |
| Ala | 97 | A | . | . | . | . | . | . | −0.06 | −0.21 | . | . | F | 0.65 | 0.72 |

TABLE 9-continued

| Res | Position | I | II | III | IV | V | VI | VII | VIII | IX | X | XI | XII | XIII | XIV |
|---|---|---|---|---|---|---|---|---|---|---|---|---|---|---|---|
| Pro | 98 | A | . | . | . | . | . | . | −0.28 | −0.21 | . | * | F | 0.65 | 0.71 |
| Lys | 99 | A | A | . | . | . | . | . | 0.07 | −0.03 | . | . | F | 0.45 | 0.59 |
| Ala | 100 | A | A | . | . | . | . | . | 0.66 | −0.46 | . | . | F | 0.60 | 1.01 |
| Gly | 101 | A | A | . | . | . | . | . | 0.41 | −0.96 | . | . | F | 0.90 | 1.13 |
| Leu | 102 | A | A | . | . | . | . | . | 0.79 | −0.89 | . | . | F | 0.75 | 0.57 |
| Glu | 103 | A | A | . | . | . | . | . | 0.41 | −0.46 | * | . | F | 0.45 | 0.88 |
| Glu | 104 | A | A | . | . | . | . | . | −0.49 | −0.46 | * | . | F | 0.45 | 0.89 |
| Ala | 105 | A | A | . | . | . | . | . | −0.21 | −0.24 | . | . | . | 0.30 | 0.81 |
| Pro | 106 | A | A | . | . | . | . | . | −0.46 | −0.44 | . | . | . | 0.30 | 0.67 |
| Ala | 107 | A | A | . | . | . | . | . | 0.01 | 0.06 | . | . | . | −0.30 | 0.39 |
| Val | 108 | A | A | . | . | . | . | . | −0.80 | 0.49 | . | * | . | −0.60 | 0.38 |
| Thr | 109 | A | A | . | . | . | . | . | −0.76 | 0.67 | . | * | . | −0.60 | 0.20 |
| Ala | 110 | A | A | . | . | . | . | . | −1.06 | 0.24 | * | * | . | −0.30 | 0.40 |
| Gly | 111 | A | A | . | . | . | . | . | −1.54 | 0.43 | * | * | . | −0.60 | 0.38 |
| Leu | 112 | A | A | . | . | . | . | . | −0.96 | 0.57 | * | * | . | −0.60 | 0.23 |
| Lys | 113 | . | A | B | . | . | . | . | −0.31 | 0.09 | * | * | . | −0.30 | 0.39 |
| Ile | 114 | . | A | B | . | . | . | . | −0.21 | 0.01 | * | . | . | −0.30 | 0.61 |
| Phe | 115 | . | A | B | . | . | . | . | −0.21 | 0.01 | * | . | . | 0.15 | 1.15 |
| Glu | 116 | . | A | . | . | . | . | C | −0.08 | −0.17 | * | . | F | 1.25 | 0.58 |
| Pro | 117 | . | A | . | . | . | . | C | 0.39 | 0.26 | * | * | F | 1.10 | 1.28 |
| Pro | 118 | . | . | . | . | . | . | C | 0.34 | −0.00 | . | . | F | 2.20 | 1.47 |
| Ala | 119 | . | . | . | . | . | T | C | 0.89 | −0.79 | . | * | F | 3.00 | 1.47 |
| Pro | 120 | . | . | . | . | . | T | C | 1.59 | −0.36 | . | * | F | 2.25 | 0.94 |
| Gly | 121 | . | . | . | . | T | T | . | 1.29 | −0.39 | . | * | F | 2.15 | 0.98 |
| Glu | 122 | . | . | . | . | T | T | . | 1.20 | −0.43 | . | . | F | 2.00 | 1.30 |
| Gly | 123 | . | . | . | . | . | . | C | 1.41 | −0.54 | . | . | F | 1.60 | 1.12 |
| Asn | 124 | . | . | . | . | . | T | C | 2.00 | −0.57 | . | . | F | 1.50 | 1.97 |
| Ser | 125 | . | . | . | . | . | T | C | 1.91 | −0.60 | . | * | F | 1.50 | 1.82 |
| Ser | 126 | . | . | . | . | . | T | C | 2.37 | −0.21 | . | * | F | 1.54 | 2.47 |
| Gln | 127 | . | . | . | . | . | T | C | 2.37 | −0.64 | . | * | F | 2.18 | 3.01 |
| Asn | 128 | . | . | . | . | . | . | C | 2.76 | −0.64 | . | . | F | 2.32 | 3.61 |
| Ser | 129 | . | . | . | . | . | T | C | 2.87 | −1.03 | . | . | F | 2.86 | 5.39 |
| Arg | 130 | . | . | . | . | T | T | . | 2.58 | −1.41 | * | . | F | 3.40 | 6.09 |
| Asn | 131 | . | . | . | . | T | T | . | 2.02 | −1.31 | * | . | F | 3.06 | 3.83 |
| Lys | 132 | . | . | . | . | T | T | . | 2.02 | −1.07 | * | . | F | 2.72 | 2.12 |
| Arg | 133 | . | . | . | . | T | . | . | 1.68 | −1.06 | * | . | F | 2.18 | 1.88 |
| Ala | 134 | . | . | . | . | . | . | C | 1.77 | −0.63 | * | . | F | 1.64 | 1.15 |
| Val | 135 | . | . | . | . | . | . | C | 1.66 | −0.60 | * | . | F | 1.49 | 0.89 |
| Gln | 136 | . | . | . | . | . | . | C | 1.66 | −0.60 | * | . | F | 1.83 | 0.79 |
| Gly | 137 | . | . | . | . | . | T | C | 1.30 | −0.60 | * | . | F | 2.52 | 1.35 |
| Pro | 138 | . | . | . | . | . | T | C | 0.33 | −0.61 | * | . | F | 2.86 | 2.63 |
| Glu | 139 | . | . | . | . | T | T | . | 0.61 | −0.61 | * | . | F | 3.40 | 1.13 |
| Glu | 140 | A | . | . | . | . | T | . | 1.47 | −0.53 | * | . | F | 2.66 | 1.64 |
| Thr | 141 | A | . | . | . | . | . | . | 1.47 | −0.56 | . | . | F | 2.12 | 1.84 |
| Val | 142 | A | . | . | . | . | . | . | 1.14 | −0.99 | . | . | F | 1.78 | 1.77 |
| Thr | 143 | A | . | . | . | . | T | . | 0.54 | −0.41 | . | . | F | 1.19 | 0.55 |
| Gln | 144 | A | . | . | . | . | T | . | 0.54 | 0.27 | * | . | F | 0.25 | 0.31 |
| Asp | 145 | A | . | . | . | . | T | . | −0.27 | 0.19 | * | . | F | 0.25 | 0.73 |
| Cys | 146 | A | . | . | . | . | T | . | −0.84 | 0.23 | * | . | . | 0.10 | 0.42 |
| Leu | 147 | A | A | . | . | . | . | . | −0.58 | 0.43 | * | . | . | −0.60 | 0.17 |
| Gln | 148 | A | A | . | . | . | . | . | −0.27 | 0.53 | * | . | . | −0.60 | 0.10 |
| Leu | 149 | A | A | . | . | . | . | . | −0.57 | 0.53 | * | * | . | −0.30 | 0.32 |
| Ile | 150 | A | A | . | . | . | . | . | −0.57 | 0.34 | * | . | . | 0.30 | 0.52 |
| Ala | 151 | . | A | . | . | . | . | C | −0.21 | −0.34 | . | * | . | 1.40 | 0.52 |
| Asp | 152 | . | . | . | . | T | T | . | 0.39 | −0.26 | . | * | F | 2.45 | 0.91 |
| Ser | 153 | . | . | . | . | . | T | C | 0.08 | −0.51 | . | . | F | 3.00 | 2.00 |
| Glu | 154 | . | . | . | . | . | T | C | −0.00 | −0.71 | . | . | F | 2.70 | 2.86 |
| Thr | 155 | . | . | . | . | . | T | C | 0.89 | −0.53 | * | . | F | 2.40 | 1.20 |
| Pro | 156 | . | . | . | B | . | . | C | 1.52 | −0.13 | * | . | F | 1.56 | 1.55 |
| Thr | 157 | . | . | . | B | T | . | . | 1.18 | −0.51 | * | . | F | 1.92 | 1.79 |
| Ile | 158 | A | . | . | B | . | . | . | 1.18 | −0.09 | . | . | F | 1.08 | 1.23 |
| Gln | 159 | . | . | . | . | T | T | . | 0.93 | −0.19 | . | . | F | 2.04 | 1.07 |
| Lys | 160 | . | . | . | . | T | T | . | 0.93 | 0.14 | * | . | F | 1.60 | 1.16 |
| Gly | 161 | . | . | . | . | T | T | . | 0.44 | 0.14 | * | . | F | 1.44 | 2.38 |
| Ser | 162 | . | . | . | . | T | T | . | −0.10 | 0.24 | * | . | F | 1.28 | 1.19 |
| Tyr | 163 | . | . | . | B | T | . | . | 0.58 | 0.49 | * | . | . | 0.12 | 0.44 |
| Thr | 164 | . | . | B | B | . | . | . | 0.29 | 0.91 | * | . | . | −0.44 | 0.69 |
| Phe | 165 | . | . | B | B | . | . | . | −0.57 | 1.40 | * | . | . | −0.60 | 0.54 |
| Val | 166 | . | . | B | B | . | . | . | −1.03 | 1.70 | . | . | . | −0.60 | 0.29 |
| Pro | 167 | . | . | B | B | . | . | . | −1.03 | 1.63 | . | . | . | −0.60 | 0.16 |
| Trp | 168 | A | . | . | B | . | . | . | −1.49 | 1.53 | . | * | . | −0.60 | 0.25 |
| Leu | 169 | A | . | . | B | . | . | . | −1.13 | 1.53 | * | . | . | −0.60 | 0.29 |
| Leu | 170 | A | . | . | B | . | . | . | −0.32 | 0.89 | * | . | . | −0.30 | 0.38 |
| Ter | 171 | A | . | . | . | . | . | . | 0.19 | 0.46 | * | . | . | 0.20 | 0.71 |
| Phe | 172 | . | . | . | . | T | . | . | 0.10 | −0.03 | * | . | . | 1.80 | 0.85 |
| Lys | 173 | . | . | . | . | T | T | . | −0.20 | −0.33 | * | . | F | 2.60 | 1.38 |
| Arg | 174 | . | . | . | . | . | T | C | −0.20 | −0.51 | . | . | F | 3.00 | 1.04 |

TABLE 9-continued

| Res | Position | I | II | III | IV | V | VI | VII | VIII | IX | X | XI | XII | XIII | XIV |
|---|---|---|---|---|---|---|---|---|---|---|---|---|---|---|---|
| Gly | 175 | . | . | . | . | . | T | C | 0.61 | −0.21 | . | . | F | 2.25 | 0.99 |
| Ser | 176 | A | . | . | . | . | T | . | 0.91 | −1.00 | * | . | F | 2.05 | 0.86 |
| Ala | 177 | A | A | . | . | . | . | . | 1.66 | −1.00 | * | . | F | 1.35 | 0.76 |
| Leu | 178 | A | A | . | . | . | . | . | 1.61 | −1.00 | . | . | F | 1.20 | 1.54 |
| Glu | 179 | A | A | . | . | . | . | . | 1.50 | −1.43 | . | . | F | 0.90 | 1.98 |
| Glu | 180 | A | A | . | . | . | . | . | 1.89 | −1.41 | * | . | F | 0.90 | 3.16 |
| Lys | 181 | A | A | . | . | . | . | . | 1.30 | −1.91 | * | . | F | 0.90 | 7.66 |
| Glu | 182 | A | A | . | . | . | . | . | 1.08 | −1.91 | . | . | F | 0.90 | 3.10 |
| Asn | 183 | A | A | . | . | . | . | . | 1.03 | −1.23 | * | * | F | 0.90 | 1.48 |
| Lys | 184 | A | A | . | . | . | . | . | 1.08 | −0.59 | * | . | F | 0.75 | 0.55 |
| Ile | 185 | A | A | . | . | . | . | . | 1.08 | −0.59 | * | * | . | 0.60 | 0.63 |
| Leu | 186 | A | A | . | . | . | . | . | 0.72 | −0.59 | * | * | . | 0.60 | 0.68 |
| Val | 187 | A | A | . | . | . | . | . | 0.38 | −0.50 | . | * | . | 0.30 | 0.49 |
| Lys | 188 | A | A | . | . | . | . | . | 0.13 | −0.07 | * | * | F | 0.45 | 0.69 |
| Glu | 189 | A | . | . | . | . | T | . | −0.61 | 0.00 | * | * | F | 0.40 | 1.32 |
| Thr | 190 | . | . | . | . | T | T | . | −0.42 | 0.10 | . | * | F | 0.80 | 1.54 |
| Gly | 191 | . | . | . | . | T | T | . | −0.50 | 0.24 | * | . | F | 0.65 | 0.67 |
| Tyr | 192 | . | . | . | . | T | T | . | 0.11 | 0.93 | * | * | . | 0.20 | 0.27 |
| Phe | 193 | . | . | B | B | . | . | . | −0.28 | 1.69 | . | . | . | −0.60 | 0.29 |
| Phe | 194 | . | . | B | B | . | . | . | −0.28 | 1.63 | . | * | . | −0.60 | 0.29 |
| Ile | 195 | . | . | B | B | . | . | . | −0.82 | 1.60 | . | . | . | −0.60 | 0.32 |
| Tyr | 196 | . | . | B | B | . | . | . | −1.29 | 1.49 | . | . | . | −0.60 | 0.28 |
| Gly | 197 | . | . | . | B | T | . | . | −1.29 | 1.39 | . | . | . | −0.20 | 0.26 |
| Gln | 198 | . | . | . | B | T | . | . | −0.90 | 1.36 | . | . | . | −0.20 | 0.59 |
| Val | 199 | . | . | . | B | . | . | C | −0.20 | 1.16 | . | . | . | −0.40 | 0.54 |
| Leu | 200 | . | . | . | B | . | . | C | 0.73 | 0.40 | . | . | . | −0.10 | 0.92 |
| Tyr | 201 | . | . | . | . | T | T | . | 0.67 | −0.03 | . | . | . | 1.25 | 1.06 |
| Thr | 202 | . | . | . | . | T | T | . | 0.77 | 0.06 | . | . | F | 0.80 | 2.06 |
| Asp | 203 | . | . | . | . | T | T | . | 0.18 | 0.17 | . | . | F | 0.80 | 3.91 |
| Lys | 204 | A | . | . | . | . | T | . | 0.43 | −0.01 | . | . | F | 1.00 | 2.52 |
| Thr | 205 | A | A | . | . | . | . | . | 0.90 | −0.16 | . | . | F | 0.60 | 1.73 |
| Tyr | 206 | A | A | . | . | . | . | . | 1.11 | −0.21 | . | . | . | 0.45 | 1.03 |
| Ala | 207 | A | A | . | . | . | . | . | 0.61 | 0.29 | . | . | . | −0.30 | 0.70 |
| Met | 208 | A | A | . | . | . | . | . | −0.28 | 0.97 | . | . | . | −0.60 | 0.40 |
| Gly | 209 | A | A | . | B | . | . | . | −0.32 | 1.17 | * | . | . | −0.60 | 0.18 |
| His | 210 | A | A | . | B | . | . | . | 0.10 | 0.81 | * | . | . | −0.60 | 0.31 |
| Leu | 211 | A | A | . | B | . | . | . | 0.39 | 0.31 | . | . | . | −0.30 | 0.61 |
| Ile | 212 | A | A | . | B | . | . | . | 1.02 | −0.30 | . | . | . | 0.45 | 1.22 |
| Gln | 213 | A | A | . | B | . | . | . | 0.77 | −0.73 | . | * | . | 0.75 | 1.80 |
| Arg | 214 | A | A | . | B | . | . | . | 1.08 | −0.59 | . | * | F | 0.90 | 1.62 |
| Lys | 215 | A | A | . | B | . | . | . | 0.26 | −0.77 | * | * | F | 0.90 | 3.14 |
| Lys | 216 | A | A | . | B | . | . | . | 0.37 | −0.81 | . | * | F | 0.90 | 1.35 |
| Val | 217 | . | A | B | B | . | . | . | 0.91 | −0.43 | * | * | . | 0.30 | 0.60 |
| His | 218 | . | A | B | B | . | . | . | 0.91 | −0.00 | . | * | . | 0.30 | 0.29 |
| Val | 219 | . | A | B | B | . | . | . | 0.80 | −0.00 | * | * | . | 0.30 | 0.25 |
| Phe | 220 | . | . | B | B | . | . | . | −0.06 | −0.00 | * | . | . | 0.30 | 0.57 |
| Gly | 221 | A | . | . | B | . | . | . | −0.40 | 0.04 | . | * | . | −0.30 | 0.35 |
| Asp | 222 | A | . | . | . | . | . | . | −0.36 | −0.07 | * | . | . | 0.50 | 0.63 |
| Glu | 223 | A | . | . | . | . | . | . | −1.18 | −0.03 | * | . | . | 0.50 | 0.60 |
| Leu | 224 | A | . | . | B | . | . | . | −0.63 | −0.17 | . | . | . | 0.30 | 0.45 |
| Ser | 225 | A | . | . | B | . | . | . | −0.74 | −0.11 | . | . | . | 0.30 | 0.39 |
| Leu | 226 | A | . | . | B | . | . | . | −1.10 | 0.57 | . | * | . | −0.60 | 0.18 |
| Val | 227 | A | . | . | B | . | . | . | −0.99 | 1.36 | . | * | . | −0.60 | 0.19 |
| Thr | 228 | A | . | . | B | . | . | . | −1.66 | 0.67 | * | * | . | −0.60 | 0.28 |
| Leu | 229 | A | . | . | B | . | . | . | −1.73 | 0.86 | * | . | . | −0.60 | 0.18 |
| Phe | 230 | A | . | . | B | . | . | . | −1.43 | 0.86 | * | . | . | −0.60 | 0.17 |
| Arg | 231 | A | . | . | B | . | . | . | −0.62 | 0.61 | * | . | . | −0.60 | 0.21 |
| Cys | 232 | . | . | . | B | T | . | . | −0.37 | 0.53 | * | . | . | −0.20 | 0.41 |
| Ile | 233 | . | . | . | B | T | . | . | −0.27 | 0.46 | * | . | . | −0.20 | 0.46 |
| Gln | 234 | . | . | . | B | T | . | . | 0.54 | 0.10 | * | . | . | 0.10 | 0.37 |
| Asn | 235 | . | . | . | B | . | . | C | 0.93 | 0.10 | * | . | . | 0.05 | 1.19 |
| Met | 236 | . | . | . | B | . | . | C | 0.01 | 0.01 | * | . | F | 0.20 | 2.44 |
| Pro | 237 | . | . | . | B | . | . | C | 0.47 | 0.01 | * | . | F | 0.44 | 1.16 |
| Glu | 238 | . | . | . | . | T | . | . | 1.36 | 0.04 | * | . | F | 1.08 | 1.12 |
| Thr | 239 | . | . | . | . | . | . | C | 1.36 | 0.04 | * | . | F | 1.12 | 1.82 |
| Leu | 240 | . | . | . | . | . | . | C | 1.06 | −0.17 | * | . | F | 1.96 | 1.89 |
| Pro | 241 | . | . | . | . | T | . | . | 0.99 | −0.21 | . | . | F | 2.40 | 1.46 |
| Asn | 242 | . | . | . | . | T | . | . | 0.96 | 0.36 | . | . | F | 1.41 | 0.54 |
| Asn | 243 | . | . | . | . | T | T | . | 0.66 | 0.63 | . | . | F | 1.22 | 1.03 |
| Ser | 244 | . | . | . | . | T | T | . | 0.38 | 0.33 | . | . | F | 1.13 | 0.89 |
| Cys | 245 | . | . | . | . | T | T | . | 0.84 | 0.40 | . | . | . | 0.74 | 0.56 |
| Tyr | 246 | . | . | . | . | T | T | . | 0.17 | 0.43 | . | . | . | 0.20 | 0.35 |
| Ser | 247 | A | . | . | . | . | . | . | −0.42 | 0.71 | . | . | . | −0.40 | 0.18 |
| Ala | 248 | A | A | . | . | . | . | . | −0.38 | 0.83 | . | . | . | −0.60 | 0.34 |
| Gly | 249 | A | A | . | . | . | . | . | −0.89 | 0.26 | . | . | . | −0.30 | 0.43 |
| Ile | 250 | A | A | . | . | . | . | . | −0.22 | 0.19 | * | . | . | −0.30 | 0.27 |
| Ala | 251 | A | A | . | . | . | . | . | 0.02 | −0.20 | * | . | . | 0.30 | 0.46 |

TABLE 9-continued

| Res | Position | I | II | III | IV | V | VI | VII | VIII | IX | X | XI | XII | XIII | XIV |
|---|---|---|---|---|---|---|---|---|---|---|---|---|---|---|---|
| Lys | 252 | A | A | . | . | . | . | . | −0.02 | −0.70 | . | . | . | 0.60 | 0.80 |
| Leu | 253 | A | A | . | . | . | . | . | 0.57 | −0.70 | . | . | F | 0.90 | 1.13 |
| Glu | 254 | A | A | . | . | . | . | . | 0.91 | −1.39 | . | . | F | 0.90 | 1.87 |
| Glu | 255 | A | A | . | . | . | . | . | 0.99 | −1.89 | . | . | F | 0.90 | 1.62 |
| Gly | 256 | A | A | . | . | . | . | . | 1.58 | −1.20 | . | * | F | 0.90 | 1.62 |
| Asp | 257 | A | A | . | . | . | . | . | 0.72 | −1.49 | . | * | F | 0.90 | 1.62 |
| Glu | 258 | A | A | . | . | . | . | . | 0.94 | −0.80 | * | * | F | 0.75 | 0.77 |
| Leu | 259 | A | A | . | . | . | . | . | 0.06 | −0.30 | * | * | . | 0.30 | 0.79 |
| Gln | 260 | A | A | . | . | . | . | . | −0.16 | −0.04 | * | . | . | 0.30 | 0.33 |
| Leu | 261 | A | A | . | . | . | . | . | 0.30 | 0.39 | * | . | . | −0.30 | 0.30 |
| Ala | 262 | A | A | . | . | . | . | . | 0.30 | 0.39 | * | . | . | −0.30 | 0.70 |
| Ile | 263 | A | A | . | . | . | . | . | 0.30 | −0.30 | . | * | . | 0.30 | 0.70 |
| Pro | 264 | A | . | . | . | . | T | . | 0.52 | −0.30 | . | * | F | 1.00 | 1.37 |
| Arg | 265 | A | . | . | . | . | T | . | 0.52 | −0.49 | . | * | F | 1.00 | 1.37 |
| Glu | 266 | A | . | . | . | . | T | . | 0.44 | −0.59 | * | * | F | 1.30 | 3.38 |
| Asn | 267 | A | . | . | . | . | T | . | 0.73 | −0.59 | * | * | F | 1.30 | 1.53 |
| Ala | 268 | A | . | . | . | . | . | . | 0.81 | −0.63 | * | * | . | 0.95 | 1.05 |
| Gln | 269 | A | . | . | . | . | . | . | 1.02 | 0.06 | * | * | . | −0.10 | 0.50 |
| Ile | 270 | A | . | . | . | . | . | . | 0.57 | 0.06 | . | * | . | 0.15 | 0.52 |
| Ser | 271 | . | . | . | . | . | . | C | 0.57 | 0.09 | . | * | . | 0.60 | 0.51 |
| Leu | 272 | . | . | . | . | . | . | C | −0.29 | −0.41 | . | * | F | 1.60 | 0.49 |
| Asp | 273 | . | . | . | . | T | T | . | −0.01 | −0.17 | . | * | F | 2.25 | 0.52 |
| Gly | 274 | . | . | . | . | T | T | . | −0.71 | −0.37 | . | * | F | 2.50 | 0.56 |
| Asp | 275 | . | . | . | . | T | T | . | −0.52 | 0.03 | . | * | F | 1.65 | 0.59 |
| Val | 276 | A | . | . | . | . | T | . | −0.57 | 0.13 | . | * | F | 1.00 | 0.30 |
| Thr | 277 | A | . | . | B | . | . | . | −0.34 | 0.56 | . | * | . | −0.10 | 0.30 |
| Phe | 278 | A | . | . | B | . | . | . | −1.16 | 0.63 | . | * | . | −0.35 | 0.18 |
| Phe | 279 | A | . | . | B | . | . | . | −0.77 | 1.31 | . | * | . | −0.60 | 0.20 |
| Gly | 280 | A | A | . | . | . | . | . | −1.58 | 0.67 | . | * | . | −0.60 | 0.28 |
| Ala | 281 | A | A | . | . | . | . | . | −1.53 | 0.87 | . | * | . | −0.60 | 0.27 |
| Leu | 282 | A | A | . | . | . | . | . | −1.61 | 0.77 | * | . | . | −0.60 | 0.26 |
| Lys | 283 | A | A | . | . | . | . | . | −1.30 | 0.41 | * | . | . | −0.60 | 0.33 |
| Leu | 284 | A | A | . | . | . | . | . | −0.99 | 0.41 | . | . | . | −0.60 | 0.42 |
| Leu | 285 | A | A | . | . | . | . | . | −1.03 | 0.34 | * | . | . | −0.30 | 0.65 |

TABLE 10

| Res | Position | I | II | III | IV | V | VI | VII | VIII | IX | X | XI | XII | XIII | XIV |
|---|---|---|---|---|---|---|---|---|---|---|---|---|---|---|---|
| Met | 1 | A | . | . | . | . | . | . | 0.73 | −0.71 | . | . | . | 0.95 | 1.39 |
| Asp | 2 | A | . | . | . | . | T | . | 1.12 | −0.66 | * | . | . | 1.15 | 1.56 |
| Asp | 3 | A | . | . | . | . | T | . | 1.62 | −1.09 | * | . | . | 1.15 | 2.12 |
| Ser | 4 | A | . | . | . | . | T | . | 2.01 | −1.51 | . | . | . | 1.15 | 4.19 |
| Thr | 5 | A | . | . | . | . | T | . | 2.40 | −2.13 | . | . | F | 1.30 | 4.35 |
| Glu | 6 | A | A | . | . | . | . | . | 2.70 | −1.73 | * | * | F | 0.90 | 4.51 |
| Arg | 7 | A | A | . | . | . | . | . | 2.81 | −1.34 | * | * | F | 0.90 | 4.51 |
| Glu | 8 | A | A | . | . | . | . | . | 2.00 | −1.73 | * | * | F | 0.90 | 6.12 |
| Gln | 9 | A | A | . | . | . | . | . | 1.99 | −1.53 | * | * | F | 0.90 | 2.91 |
| Ser | 10 | A | . | . | B | . | . | . | 2.00 | −1.04 | * | * | F | 0.90 | 2.15 |
| Arg | 11 | A | . | . | B | . | . | . | 1.33 | −0.66 | * | * | F | 0.90 | 1.66 |
| Leu | 12 | A | . | . | B | . | . | . | 0.41 | −0.09 | * | * | F | 0.45 | 0.51 |
| Thr | 13 | A | . | . | B | . | . | . | 0.46 | 0.20 | * | * | F | −0.15 | 0.32 |
| Ser | 14 | A | A | . | . | . | . | . | 0.50 | −0.19 | * | * | . | 0.30 | 0.32 |
| Cys | 15 | A | A | . | . | . | . | . | 0.91 | −0.19 | * | * | . | 0.30 | 0.78 |
| Leu | 16 | A | A | . | . | . | . | . | 0.80 | −0.87 | * | * | F | 0.90 | 1.06 |
| Lys | 17 | A | A | . | . | . | . | . | 1.61 | −1.36 | . | * | F | 0.90 | 1.37 |
| Lys | 18 | A | A | . | . | . | . | . | 1.32 | −1.74 | . | * | F | 0.90 | 4.44 |
| Arg | 19 | A | A | . | . | . | . | . | 1.67 | −1.70 | . | * | F | 0.90 | 5.33 |
| Glu | 20 | A | A | . | . | . | . | . | 1.52 | −2.39 | . | * | F | 0.90 | 5.33 |
| Glu | 21 | A | A | . | . | . | . | . | 2.38 | −1.70 | . | * | F | 0.90 | 2.20 |
| Met | 22 | A | A | . | . | . | . | . | 2.33 | −1.70 | . | * | F | 0.90 | 2.24 |
| Lys | 23 | A | A | . | . | . | . | . | 1.62 | −1.70 | * | * | F | 0.90 | 2.24 |
| Leu | 24 | A | A | . | . | . | . | . | 0.66 | −1.13 | * | * | F | 0.75 | 0.69 |
| Lys | 25 | A | A | . | . | . | . | . | 0.36 | −0.49 | . | * | F | 0.45 | 0.52 |
| Glu | 26 | A | A | . | B | . | . | . | −0.53 | −0.71 | * | * | . | 0.60 | 0.35 |
| Cys | 27 | A | A | . | B | . | . | . | −0.74 | −0.03 | * | * | . | 0.30 | 0.30 |
| Val | 28 | A | A | . | B | . | . | . | −1.00 | −0.03 | * | * | . | 0.30 | 0.12 |
| Ser | 29 | A | A | . | B | . | . | . | −0.08 | 0.40 | * | * | . | −0.30 | 0.11 |
| Ile | 30 | A | . | . | B | . | . | . | −0.08 | 0.40 | * | * | . | −0.30 | 0.40 |
| Leu | 31 | A | . | . | B | . | . | . | −0.08 | −0.17 | * | . | . | 0.45 | 1.08 |
| Pro | 32 | . | . | . | B | . | . | C | 0.29 | −0.81 | * | . | F | 1.10 | 1.39 |
| Arg | 33 | . | . | . | . | T | . | . | 0.93 | −0.81 | . | * | F | 1.50 | 2.66 |
| Lys | 34 | . | . | . | . | T | . | . | 0.93 | −1.07 | . | . | F | 1.84 | 4.98 |
| Glu | 35 | . | . | . | . | . | . | C | 0.97 | −1.37 | * | * | F | 1.98 | 4.32 |

TABLE 10-continued

| Res | Position | I | II | III | IV | V | VI | VII | VIII | IX | X | XI | XII | XIII | XIV |
|---|---|---|---|---|---|---|---|---|---|---|---|---|---|---|---|
| Ser | 36 | . | . | . | . | . | T | C | 1.89 | −1.16 | * | * | F | 2.52 | 1.64 |
| Pro | 37 | . | . | . | . | . | T | C | 1.80 | −1.16 | * | * | F | 2.86 | 1.60 |
| Ser | 38 | . | . | . | . | T | T | . | 1.39 | −0.77 | * | . | F | 3.40 | 1.24 |
| Val | 39 | A | . | . | . | . | T | . | 1.39 | −0.39 | . | * | F | 2.36 | 1.24 |
| Arg | 40 | A | . | . | . | . | . | . | 1.39 | −0.77 | * | * | F | 2.46 | 1.60 |
| Ser | 41 | A | . | . | . | . | . | . | 1.34 | −1.20 | * | * | F | 2.46 | 2.00 |
| Ser | 42 | . | . | . | . | T | T | . | 1.60 | −1.16 | . | * | F | 3.06 | 2.67 |
| Lys | 43 | . | . | . | . | T | T | . | 1.09 | −1.80 | * | * | F | 3.06 | 2.72 |
| Asp | 44 | . | . | . | . | T | T | . | 1.13 | −1.11 | * | * | F | 3.40 | 1.67 |
| Gly | 45 | A | . | . | . | . | T | . | 0.43 | −0.81 | * | * | F | 2.66 | 1.03 |
| Lys | 46 | A | A | . | . | . | . | . | 0.14 | −0.70 | . | . | F | 1.77 | 0.52 |
| Leu | 47 | A | A | . | . | . | . | . | 0.13 | −0.20 | * | . | . | 0.98 | 0.31 |
| Leu | 48 | A | A | . | . | . | . | . | −0.72 | 0.29 | * | . | . | 0.04 | 0.46 |
| Ala | 49 | A | A | . | . | . | . | . | −1.53 | 0.54 | . | * | . | −0.60 | 0.19 |
| Ala | 50 | A | A | . | . | . | . | . | −2.00 | 1.23 | . | . | . | −0.60 | 0.19 |
| Thr | 51 | A | A | . | . | . | . | . | −2.63 | 1.23 | . | . | . | −0.60 | 0.19 |
| Leu | 52 | A | A | . | . | . | . | . | −2.63 | 1.04 | . | . | . | −0.60 | 0.19 |
| Leu | 53 | A | A | . | . | . | . | . | −2.63 | 1.23 | . | . | . | −0.60 | 0.15 |
| Leu | 54 | A | A | . | . | . | . | . | −2.34 | 1.41 | . | . | . | −0.60 | 0.09 |
| Ala | 55 | A | A | . | . | . | . | . | −2.42 | 1.31 | . | . | . | −0.60 | 0.14 |
| Leu | 56 | A | A | . | . | . | . | . | −2.78 | 1.20 | . | . | . | −0.60 | 0.09 |
| Leu | 57 | A | . | . | . | . | T | . | −2.78 | 1.09 | . | . | . | −0.20 | 0.06 |
| Ser | 58 | A | . | . | . | . | T | . | −2.28 | 1.09 | . | . | . | −0.20 | 0.05 |
| Cys | 59 | A | . | . | . | . | T | . | −2.32 | 1.07 | . | . | . | −0.20 | 0.09 |
| Cys | 60 | A | . | . | . | . | T | . | −2.59 | 1.03 | . | . | . | −0.20 | 0.08 |
| Leu | 61 | . | . | B | B | . | . | . | −2.08 | 0.99 | . | . | . | −0.60 | 0.04 |
| Thr | 62 | . | . | B | B | . | . | . | −1.97 | 0.99 | . | . | . | −0.60 | 0.11 |
| Val | 63 | . | . | B | B | . | . | . | −1.91 | 1.20 | . | . | . | −0.60 | 0.17 |
| Val | 64 | . | . | B | B | . | . | . | −1.24 | 1.39 | . | . | . | −0.60 | 0.33 |
| Ser | 65 | . | . | B | B | . | . | . | −1.43 | 1.10 | . | . | . | −0.60 | 0.40 |
| Phe | 66 | A | . | . | B | . | . | . | −1.21 | 1.26 | . | . | . | −0.60 | 0.40 |
| Tyr | 67 | A | . | . | B | . | . | . | −1.49 | 1.11 | . | . | . | −0.60 | 0.54 |
| Gln | 68 | A | . | . | B | . | . | . | −1.44 | 0.97 | . | . | . | −0.60 | 0.41 |
| Val | 69 | A | . | . | B | . | . | . | −0.59 | 1.27 | . | . | . | −0.60 | 0.39 |
| Ala | 70 | A | . | . | B | . | . | . | −0.63 | 0.89 | . | . | . | −0.60 | 0.43 |
| Ala | 71 | A | . | . | B | . | . | . | 0.07 | 0.56 | . | * | . | −0.60 | 0.25 |
| Leu | 72 | A | . | . | . | . | T | . | −0.50 | 0.16 | . | . | . | 0.10 | 0.55 |
| Gln | 73 | A | . | . | . | . | T | . | −1.09 | 0.20 | . | . | F | 0.25 | 0.45 |
| Gly | 74 | A | . | . | . | . | T | . | −0.53 | 0.20 | . | . | F | 0.25 | 0.45 |
| Asp | 75 | A | . | . | . | . | T | . | −0.76 | 0.09 | . | * | F | 0.25 | 0.73 |
| Leu | 76 | A | A | . | . | . | . | . | −0.06 | 0.09 | . | * | F | −0.15 | 0.35 |
| Ala | 77 | A | A | . | . | . | . | . | 0.17 | −0.31 | . | * | . | 0.30 | 0.69 |
| Ser | 78 | A | A | . | . | . | . | . | 0.17 | −0.24 | . | * | . | 0.30 | 0.42 |
| Leu | 79 | A | A | . | . | . | . | . | −0.30 | −0.24 | . | * | . | 0.30 | 0.88 |
| Arg | 80 | A | A | . | . | . | . | . | −0.30 | −0.24 | . | * | . | 0.30 | 0.72 |
| Ala | 81 | A | A | . | . | . | . | . | 0.17 | −0.34 | . | * | . | 0.30 | 0.93 |
| Glu | 82 | A | A | . | . | . | . | . | 0.72 | −0.30 | . | * | . | 0.45 | 1.11 |
| Leu | 83 | A | A | . | . | . | . | . | 0.99 | −0.49 | . | * | . | 0.30 | 0.77 |
| Gln | 84 | A | A | . | . | . | . | . | 1.21 | 0.01 | . | * | . | −0.15 | 1.04 |
| Gly | 85 | A | A | . | . | . | . | . | 1.10 | 0.01 | * | * | . | −0.30 | 0.61 |
| His | 86 | A | A | . | . | . | . | . | 1.73 | 0.01 | * | * | . | −0.15 | 1.27 |
| His | 87 | A | A | . | . | . | . | . | 0.92 | −0.67 | . | * | . | 0.75 | 1.47 |
| Ala | 88 | A | A | . | . | . | . | . | 1.52 | −0.39 | . | * | . | 0.45 | 1.22 |
| Glu | 89 | A | A | . | . | . | . | . | 0.93 | −0.39 | . | . | . | 0.45 | 1.39 |
| Lys | 90 | A | A | . | . | . | . | . | 0.93 | −0.39 | * | . | F | 0.60 | 1.03 |
| Leu | 91 | A | . | . | . | . | T | . | 0.38 | −0.46 | * | . | . | 0.85 | 1.01 |
| Pro | 92 | A | . | . | . | . | T | . | 0.07 | −0.46 | . | . | . | 0.70 | 0.59 |
| Ala | 93 | A | . | . | . | . | T | . | 0.07 | −0.03 | . | . | . | 0.70 | 0.29 |
| Gly | 94 | A | . | . | . | . | T | . | −0.14 | 0.47 | . | . | . | −0.20 | 0.36 |
| Ala | 95 | A | . | . | . | . | . | . | −0.14 | 0.21 | . | * | . | −0.10 | 0.36 |
| Gly | 96 | A | . | . | . | . | . | . | 0.08 | −0.21 | . | . | F | 0.65 | 0.71 |
| Ala | 97 | A | . | . | . | . | . | . | −0.06 | −0.21 | . | . | F | 0.65 | 0.72 |
| Pro | 98 | A | . | . | . | . | . | . | −0.28 | −0.21 | . | * | F | 0.65 | 0.71 |
| Lys | 99 | A | A | . | . | . | . | . | 0.07 | −0.03 | . | . | F | 0.45 | 0.59 |
| Ala | 100 | A | A | . | . | . | . | . | 0.66 | −0.46 | . | . | F | 0.60 | 1.01 |
| Gly | 101 | A | A | . | . | . | . | . | 0.41 | −0.96 | . | . | F | 0.90 | 1.13 |
| Leu | 102 | A | A | . | . | . | . | . | 0.79 | −0.89 | . | . | F | 0.75 | 0.57 |
| Glu | 103 | A | A | . | . | . | . | . | 0.41 | −0.46 | * | . | F | 0.45 | 0.88 |
| Glu | 104 | A | A | . | . | . | . | . | −0.49 | −0.46 | * | . | F | 0.45 | 0.89 |
| Ala | 105 | A | A | . | . | . | . | . | −0.21 | −0.24 | . | . | . | 0.30 | 0.81 |
| Pro | 106 | A | A | . | . | . | . | . | −0.46 | −0.44 | . | . | . | 0.30 | 0.67 |
| Ala | 107 | A | A | . | . | . | . | . | 0.01 | 0.06 | . | . | . | −0.30 | 0.39 |
| Val | 108 | A | A | . | . | . | . | . | −0.80 | 0.49 | * | * | . | −0.60 | 0.38 |
| Thr | 109 | A | A | . | . | . | . | . | −0.76 | 0.67 | . | * | . | −0.60 | 0.20 |
| Ala | 110 | A | A | . | . | . | . | . | −1.06 | 0.24 | * | * | . | −0.30 | 0.40 |
| Gly | 111 | A | A | . | . | . | . | . | −1.54 | 0.43 | * | * | . | −0.60 | 0.38 |
| Leu | 112 | A | A | . | . | . | . | . | −0.96 | 0.57 | * | * | . | −0.60 | 0.23 |

TABLE 10-continued

| Res | Position | I | II | III | IV | V | VI | VII | VIII | IX | X | XI | XII | XIII | XIV |
|---|---|---|---|---|---|---|---|---|---|---|---|---|---|---|---|
| Lys | 113 | . | A | B | . | . | . | . | -0.31 | 0.09 | * | * | . | -0.30 | 0.39 |
| Ile | 114 | . | A | B | . | . | . | . | -0.21 | 0.01 | * | . | . | -0.30 | 0.61 |
| Phe | 115 | . | A | B | . | . | . | . | -0.21 | 0.01 | * | . | . | 0.15 | 1.15 |
| Glu | 116 | . | A | . | . | . | . | C | -0.08 | -0.17 | * | . | F | 1.25 | 0.58 |
| Pro | 117 | . | A | . | . | . | . | C | 0.39 | 0.26 | * | * | F | 1.10 | 1.28 |
| Pro | 118 | . | . | . | . | . | . | C | 0.34 | 0.00 | * | . | F | 2.20 | 1.47 |
| Ala | 119 | . | . | . | . | . | T | C | 0.89 | -0.79 | . | * | F | 3.00 | 1.47 |
| Pro | 120 | . | . | . | . | . | T | C | 1.59 | -0.36 | . | * | F | 2.25 | 0.94 |
| Gly | 121 | . | . | . | . | T | T | . | 1.29 | -0.39 | . | * | F | 2.15 | 0.98 |
| Glu | 122 | . | . | . | . | T | T | . | 1.20 | -0.43 | . | . | F | 2.00 | 1.30 |
| Gly | 123 | . | . | . | . | . | . | C | 1.41 | -0.54 | . | . | F | 1.60 | 1.12 |
| Asn | 124 | . | . | . | . | . | T | C | 2.00 | -0.57 | . | . | F | 1.50 | 1.97 |
| Ser | 125 | . | . | . | . | . | T | C | 1.91 | -0.60 | . | * | F | 1.50 | 1.82 |
| Ser | 126 | . | . | . | . | . | T | C | 2.37 | -0.21 | . | * | F | 1.54 | 2.47 |
| Gln | 127 | . | . | . | . | . | T | C | 2.37 | -0.64 | . | * | F | 2.18 | 3.01 |
| Asn | 128 | . | . | . | . | . | . | C | 2.76 | -0.64 | . | . | F | 2.32 | 3.61 |
| Ser | 129 | . | . | . | . | . | T | C | 2.87 | -1.03 | . | . | F | 2.86 | 5.39 |
| Arg | 130 | . | . | . | . | T | T | . | 2.58 | -1.41 | * | . | F | 3.40 | 6.09 |
| Asn | 131 | . | . | . | . | T | T | . | 2.02 | -1.31 | * | . | F | 3.06 | 3.83 |
| Lys | 132 | . | . | . | . | T | T | . | 2.02 | -1.07 | * | . | F | 2.72 | 2.12 |
| Arg | 133 | . | . | . | . | T | . | . | 1.68 | -1.06 | * | . | F | 2.18 | 1.88 |
| Ala | 134 | . | . | . | . | . | . | C | 1.77 | -0.63 | * | . | F | 1.64 | 1.15 |
| Val | 135 | . | . | . | . | . | . | C | 1.66 | -0.60 | * | . | F | 1.15 | 0.89 |
| Gln | 136 | . | . | . | . | . | . | C | 1.66 | -0.60 | * | . | F | 1.49 | 0.79 |
| Gly | 137 | . | . | . | . | . | T | C | 1.30 | -0.60 | * | . | F | 2.18 | 1.35 |
| Pro | 138 | . | . | . | . | . | T | C | 0.84 | -0.61 | * | . | F | 2.52 | 2.63 |
| Glu | 139 | . | . | . | . | . | T | C | 1.13 | -0.83 | * | . | F | 2.86 | 1.50 |
| Glu | 140 | . | . | . | . | T | T | . | 1.74 | -0.84 | . | . | F | 3.40 | 2.03 |
| Thr | 141 | . | . | . | . | T | . | . | 1.43 | -0.51 | . | . | F | 2.86 | 2.06 |
| Gly | 142 | . | . | . | . | T | T | . | 1.08 | -0.46 | . | . | F | 2.42 | 1.72 |
| Ser | 143 | . | . | . | . | T | T | . | 0.43 | 0.33 | . | . | F | 1.33 | 0.86 |
| Tyr | 144 | . | . | . | . | T | T | . | 0.22 | 0.97 | . | . | . | 0.54 | 0.44 |
| Thr | 145 | . | . | . | . | T | T | . | -0.07 | 0.91 | . | . | . | 0.20 | 0.69 |
| Phe | 146 | . | . | B | B | . | . | . | -0.57 | 1.40 | . | . | . | -0.60 | 0.54 |
| Val | 147 | . | . | B | B | . | . | . | -1.03 | 1.70 | . | . | . | -0.60 | 0.29 |
| Pro | 148 | . | . | B | B | . | . | . | -1.03 | 1.63 | . | . | . | -0.60 | 0.16 |
| Trp | 149 | A | . | . | B | . | . | . | -1.49 | 1.53 | . | * | . | -0.60 | 0.25 |
| Leu | 150 | A | . | . | B | . | . | . | -1.13 | 1.53 | * | . | . | -0.60 | 0.29 |
| Leu | 151 | A | . | . | B | . | . | . | -0.32 | 0.89 | * | . | . | -0.30 | 0.38 |
| Ser | 152 | A | . | . | . | . | . | . | 0.19 | 0.46 | * | . | . | 0.20 | 0.71 |
| Phe | 153 | . | . | . | . | T | . | . | 0.10 | -0.03 | * | . | . | 1.80 | 0.85 |
| Lys | 154 | . | . | . | . | T | T | . | -0.20 | -0.33 | * | . | F | 2.60 | 1.38 |
| Arg | 155 | . | . | . | . | . | T | C | -0.20 | -0.51 | . | . | F | 3.00 | 1.04 |
| Gly | 156 | . | . | . | . | . | T | C | 0.61 | -0.21 | . | . | F | 2.25 | 0.99 |
| Ser | 157 | A | . | . | . | . | T | . | 0.91 | -1.00 | * | . | F | 2.05 | 0.86 |
| Ala | 158 | A | A | . | . | . | . | . | 1.66 | -1.00 | * | . | F | 1.35 | 0.76 |
| Leu | 159 | A | A | . | . | . | . | . | 1.61 | -1.00 | . | . | F | 1.20 | 1.54 |
| Glu | 160 | A | A | . | . | . | . | . | 1.50 | -1.43 | . | . | F | 0.90 | 1.98 |
| Glu | 161 | A | A | . | . | . | . | . | 1.89 | -1.41 | * | . | F | 0.90 | 3.16 |
| Lys | 162 | A | A | . | . | . | . | . | 1.30 | -1.91 | * | . | F | 0.90 | 7.66 |
| Glu | 163 | A | A | . | . | . | . | . | 1.08 | -1.91 | . | . | F | 0.90 | 3.10 |
| Asn | 164 | A | A | . | . | . | . | . | 1.03 | -1.23 | * | * | F | 0.90 | 1.48 |
| Lys | 165 | A | A | . | . | . | . | . | 1.08 | -0.59 | * | . | F | 0.75 | 0.55 |
| Ile | 166 | A | A | . | . | . | . | . | 1.08 | -0.59 | * | * | . | 0.60 | 0.63 |
| Leu | 167 | A | A | . | . | . | . | . | 0.72 | -0.59 | * | * | . | 0.76 | 0.68 |
| Val | 168 | A | A | . | . | . | . | . | 0.38 | -0.50 | . | * | . | 0.92 | 0.49 |
| Lys | 169 | A | A | . | . | . | . | . | 0.13 | -0.07 | * | * | F | 0.93 | 0.69 |
| Glu | 170 | A | . | . | . | . | T | . | -0.61 | 0.00 | * | * | F | 1.64 | 1.32 |
| Thr | 171 | . | . | . | . | T | T | . | -0.42 | 0.10 | . | * | F | 1.60 | 1.54 |
| Gly | 172 | . | . | . | . | T | T | . | -0.50 | 0.24 | * | . | F | 1.29 | 0.67 |
| Tyr | 173 | . | . | . | . | T | T | . | 0.11 | 0.93 | * | * | . | 0.68 | 0.27 |
| Phe | 174 | . | . | B | B | . | . | . | -0.28 | 1.69 | . | . | . | -0.28 | 0.29 |
| Phe | 175 | . | . | B | B | . | . | . | -0.28 | 1.63 | . | * | . | -0.44 | 0.29 |
| Ile | 176 | . | . | B | B | . | . | . | -0.82 | 1.60 | . | . | . | -0.60 | 0.32 |
| Tyr | 177 | . | . | B | B | . | . | . | -1.29 | 1.49 | . | . | . | -0.60 | 0.28 |
| Gly | 178 | . | . | . | B | T | . | . | -1.29 | 1.39 | . | . | . | -0.20 | 0.26 |
| Gln | 179 | . | . | . | B | T | . | . | -0.90 | 1.36 | . | . | . | -0.20 | 0.59 |
| Val | 180 | . | . | . | B | . | . | C | -0.20 | 1.16 | . | . | . | -0.40 | 0.54 |
| Leu | 181 | . | . | . | B | . | . | C | 0.73 | 0.40 | . | . | . | -0.10 | 0.92 |
| Tyr | 182 | . | . | . | . | T | T | . | 0.67 | -0.03 | . | . | . | 1.25 | 1.06 |
| Thr | 183 | . | . | . | . | T | T | . | 0.77 | 0.06 | . | . | F | 0.80 | 2.06 |
| Asp | 184 | . | . | . | . | T | T | . | 0.18 | 0.17 | . | . | F | 0.80 | 3.91 |
| Lys | 185 | A | . | . | . | . | T | . | 0.43 | -0.01 | . | . | F | 1.00 | 2.52 |
| Thr | 186 | A | A | . | . | . | . | . | 0.90 | -0.16 | . | . | F | 0.60 | 1.73 |
| Tyr | 187 | A | A | . | . | . | . | . | 1.11 | -0.21 | . | . | . | 0.45 | 1.03 |
| Ala | 188 | A | A | . | . | . | . | . | 0.61 | 0.29 | . | . | . | -0.30 | 0.70 |
| Met | 189 | A | A | . | . | . | . | . | -0.28 | 0.97 | . | . | . | -0.60 | 0.40 |

TABLE 10-continued

| Res | Position | I | II | III | IV | V | VI | VII | VIII | IX | X | XI | XII | XIII | XIV |
|---|---|---|---|---|---|---|---|---|---|---|---|---|---|---|---|
| Gly | 190 | A | A | . | B | . | . | . | −0.32 | 1.17 | * | . | . | −0.60 | 0.18 |
| His | 191 | A | A | . | B | . | . | . | 0.10 | 0.81 | * | . | . | −0.60 | 0.31 |
| Leu | 192 | A | A | . | B | . | . | . | 0.39 | 0.31 | . | . | . | −0.30 | 0.61 |
| Ile | 193 | A | A | . | B | . | . | . | 1.02 | −0.30 | . | . | . | 0.45 | 1.22 |
| Gln | 194 | A | A | . | B | . | . | . | 0.77 | −0.73 | . | * | . | 0.75 | 1.80 |
| Arg | 195 | A | A | . | B | . | . | . | 1.08 | −0.59 | * | * | F | 0.90 | 1.62 |
| Lys | 196 | A | A | . | B | . | . | . | 0.26 | −0.77 | * | * | F | 0.90 | 3.14 |
| Lys | 197 | A | A | . | B | . | . | . | 0.37 | −0.81 | . | * | F | 0.90 | 1.35 |
| Val | 198 | . | A | B | B | . | . | . | 0.91 | −0.43 | * | * | . | 0.30 | 0.60 |
| His | 199 | . | A | B | B | . | . | . | 0.91 | 0.00 | * | * | . | 0.30 | 0.29 |
| Val | 200 | . | A | B | B | . | . | . | 0.80 | 0.00 | * | * | . | 0.30 | 0.25 |
| Phe | 201 | . | . | B | B | . | . | . | −0.06 | 0.00 | * | . | . | 0.30 | 0.57 |
| Gly | 202 | A | . | . | B | . | . | . | −0.40 | 0.04 | . | * | . | −0.30 | 0.35 |
| Asp | 203 | A | . | . | . | . | . | . | −0.36 | −0.07 | * | . | . | 0.50 | 0.63 |
| Glu | 204 | A | . | . | . | . | . | . | −1.18 | −0.03 | * | . | . | 0.50 | 0.60 |
| Leu | 205 | A | . | . | B | . | . | . | −0.63 | −0.17 | . | . | . | 0.30 | 0.45 |
| Ser | 206 | A | . | . | B | . | . | . | −0.74 | −0.11 | . | . | . | 0.30 | 0.39 |
| Leu | 207 | A | . | . | B | . | . | . | −1.10 | 0.57 | . | * | . | −0.60 | 0.18 |
| Val | 208 | A | . | . | B | . | . | . | −0.99 | 1.36 | . | * | . | −0.60 | 0.19 |
| Thr | 209 | A | . | . | B | . | . | . | −1.66 | 0.67 | * | * | . | −0.60 | 0.28 |
| Leu | 210 | A | . | . | B | . | . | . | −1.73 | 0.86 | * | . | . | −0.60 | 0.18 |
| Phe | 211 | A | . | . | B | . | . | . | −1.43 | 0.86 | * | . | . | −0.60 | 0.17 |
| Arg | 212 | A | . | . | B | . | . | . | −0.62 | 0.61 | * | . | . | −0.60 | 0.21 |
| Cys | 213 | . | . | . | B | T | . | . | −0.37 | 0.53 | * | . | . | −0.20 | 0.41 |
| Ile | 214 | . | . | . | B | T | . | . | −0.27 | 0.46 | * | . | . | −0.20 | 0.46 |
| Gln | 215 | . | . | . | B | T | . | . | 0.54 | 0.10 | * | . | . | 0.10 | 0.37 |
| Asn | 216 | . | . | . | B | . | . | C | 0.93 | 0.10 | * | . | . | 0.05 | 1.19 |
| Met | 217 | . | . | . | B | . | . | C | 0.01 | 0.01 | * | . | F | 0.20 | 2.44 |
| Pro | 218 | . | . | . | B | . | . | C | 0.47 | 0.01 | * | . | F | 0.44 | 1.16 |
| Glu | 219 | . | . | . | . | T | . | . | 1.36 | 0.04 | * | . | F | 1.08 | 1.12 |
| Thr | 220 | . | . | . | . | . | . | C | 1.36 | 0.04 | * | . | F | 1.12 | 1.82 |
| Leu | 221 | . | . | . | . | . | . | C | 1.06 | −0.17 | * | . | F | 1.96 | 1.89 |
| Pro | 222 | . | . | . | . | T | . | . | 0.99 | −0.21 | . | . | F | 2.40 | 1.46 |
| Asn | 223 | . | . | . | . | T | . | . | 0.96 | 0.36 | . | . | F | 1.41 | 0.54 |
| Asn | 224 | . | . | . | . | T | T | . | 0.66 | 0.63 | . | . | F | 1.22 | 1.03 |
| Ser | 225 | . | . | . | . | T | T | . | 0.38 | 0.33 | . | . | F | 1.13 | 0.89 |
| Cys | 226 | . | . | . | . | T | T | . | 0.84 | 0.40 | . | . | . | 0.74 | 0.56 |
| Tyr | 227 | . | . | . | . | T | T | . | 0.17 | 0.43 | . | . | . | 0.20 | 0.35 |
| Ser | 228 | A | . | . | . | . | . | . | −0.42 | 0.71 | . | . | . | −0.40 | 0.18 |
| Ala | 229 | A | A | . | . | . | . | . | −0.38 | 0.83 | . | . | . | −0.60 | 0.34 |
| Gly | 230 | A | A | . | . | . | . | . | −0.89 | 0.26 | . | . | . | −0.30 | 0.43 |
| Ile | 231 | A | A | . | . | . | . | . | −0.22 | 0.19 | * | . | . | −0.30 | 0.27 |
| Ala | 232 | A | A | . | . | . | . | . | 0.02 | −0.20 | * | . | . | 0.30 | 0.46 |
| Lys | 233 | A | A | . | . | . | . | . | −0.02 | −0.70 | . | . | . | 0.60 | 0.80 |
| Leu | 234 | A | A | . | . | . | . | . | 0.57 | −0.70 | . | . | F | 0.90 | 1.13 |
| Glu | 235 | A | A | . | . | . | . | . | 0.91 | −1.39 | . | . | F | 0.90 | 1.87 |
| Glu | 236 | A | A | . | . | . | . | . | 0.99 | −1.89 | . | . | F | 0.90 | 1.62 |
| Gly | 237 | A | A | . | . | . | . | . | 1.58 | −1.20 | . | * | F | 0.90 | 1.62 |
| Asp | 238 | A | A | . | . | . | . | . | 0.72 | −1.49 | . | * | F | 0.90 | 1.62 |
| Glu | 239 | A | A | . | . | . | . | . | 0.94 | −0.80 | * | * | F | 0.75 | 0.77 |
| Leu | 240 | A | A | . | . | . | . | . | 0.06 | −0.30 | * | * | . | 0.30 | 0.79 |
| Gln | 241 | A | A | . | . | . | . | . | −0.16 | −0.04 | * | . | . | 0.30 | 0.33 |
| Leu | 242 | A | A | . | . | . | . | . | 0.30 | 0.39 | * | . | . | −0.30 | 0.30 |
| Ala | 243 | A | A | . | . | . | . | . | 0.30 | 0.39 | * | . | . | −0.30 | 0.70 |
| Ile | 244 | A | A | . | . | . | . | . | 0.30 | −0.30 | . | * | . | 0.30 | 0.70 |
| Pro | 245 | A | . | . | . | . | T | . | 0.52 | −0.30 | . | * | F | 1.00 | 1.37 |
| Arg | 246 | A | . | . | . | . | T | . | 0.52 | −0.49 | . | * | F | 1.00 | 1.37 |
| Glu | 247 | A | . | . | . | . | T | . | 0.44 | −0.59 | * | * | F | 1.30 | 3.38 |
| Asn | 248 | A | . | . | . | . | T | . | 0.73 | −0.59 | * | * | F | 1.30 | 1.53 |
| Ala | 249 | A | . | . | . | . | . | . | 0.81 | −0.63 | * | * | . | 0.95 | 1.05 |
| Gln | 250 | A | . | . | . | . | . | . | 1.02 | 0.06 | * | * | . | −0.10 | 0.50 |
| Ile | 251 | A | . | . | . | . | . | . | 0.57 | 0.06 | * | * | . | 0.15 | 0.52 |
| Ser | 252 | . | . | . | . | . | . | C | 0.57 | 0.09 | . | * | . | 0.60 | 0.51 |
| Leu | 253 | . | . | . | . | . | . | C | −0.29 | −0.41 | . | * | F | 1.60 | 0.49 |
| Asp | 254 | . | . | . | . | T | T | . | −0.01 | −0.17 | . | * | F | 2.25 | 0.52 |
| Gly | 255 | . | . | . | . | T | T | . | −0.71 | −0.37 | . | * | F | 2.50 | 0.56 |
| Asp | 256 | . | . | . | . | T | T | . | −0.52 | 0.03 | . | * | F | 1.65 | 0.59 |
| Val | 257 | A | . | . | . | . | T | . | −0.57 | 0.13 | . | * | F | 1.00 | 0.30 |
| Thr | 258 | A | . | . | B | . | . | . | −0.34 | 0.56 | . | * | . | −0.10 | 0.30 |
| Phe | 259 | A | . | . | B | . | . | . | −1.16 | 0.63 | . | * | . | −0.35 | 0.18 |
| Phe | 260 | A | . | . | B | . | . | . | −0.77 | 1.31 | . | * | . | −0.60 | 0.20 |
| Gly | 261 | A | A | . | . | . | . | . | −1.58 | 0.67 | . | * | . | −0.60 | 0.28 |
| Ala | 262 | A | A | . | . | . | . | . | −1.53 | 0.87 | . | * | . | −0.60 | 0.27 |
| Leu | 263 | A | A | . | . | . | . | . | −1.61 | 0.77 | * | . | . | −0.60 | 0.26 |
| Lys | 264 | A | A | . | . | . | . | . | −1.30 | 0.41 | * | . | . | −0.60 | 0.33 |

TABLE 10-continued

| Res | Position | I | II | III | IV | V | VI | VII | VIII | IX | X | XI | XII | XIII | XIV |
|---|---|---|---|---|---|---|---|---|---|---|---|---|---|---|---|
| Leu | 265 | A | A | . | . | . | . | . | −0.99 | 0.41 | . | . | . | −0.60 | 0.42 |
| Leu | 266 | A | A | . | . | . | . | . | −1.03 | 0.34 | * | . | . | −0.30 | 0.65 |

In another embodiment, the invention provides antibodies that bind a polypeptide comprising, or alternatively consisting of, an epitope-bearing portion of a polypeptide of the invention. The epitope of this polypeptide portion may be an immunogenic or antigenic epitope of a polypeptide of the invention. An "immunogenic epitope" is defined as a part of a protein that elicits an antibody response when the whole protein is the immunogen. On the other hand, a region of a protein molecule to which an antibody can bind is defined as an "antigenic epitope." The number of immunogenic epitopes of a protein generally is less than the number of antigenic epitopes. See, for instance, Geysen et al., *Proc. Natl. Acad. Sci. USA* 81:3998–4002 (1983).

As to the selection of polypeptides bearing an antigenic epitope (i.e., that contain a region of a protein molecule to which an antibody can bind), it is well known in that art that relatively short synthetic peptides that mimic part of a protein sequence are routinely capable of eliciting an antiserum that reacts with the partially mimicked protein. See, for instance, Sutcliffe, J. G., Shinnick, T. M., Green, N. and Learner, R. A. (1983) "Antibodies that react with predetermined sites on proteins", *Science,* 219:660–666. Peptides capable of eliciting protein-reactive sera are frequently represented in the primary sequence of a protein, can be characterized by a set of simple chemical rules, and are confined neither to immunodominant regions of intact proteins (i.e., immunogenic epitopes) nor to the amino or carboxyl terminals. Antigenic epitope-bearing peptides and polypeptides of the invention are therefore useful to raise antibodies, including monoclonal antibodies, that bind specifically to a polypeptide of the invention. See, for instance, Wilson et al., *Cell* 37:767–778 (1984) at 777.

In specific embodiments, antibodies of the present invention bind antigenic epitope-bearing peptides and polypeptides of B Lymphocyte Stimulator and preferably contain a sequence of at least 4, at least 5, at least 6, at least 7, more preferably at least 8, at least 9, at least 10, at least 11, at least 12, at least 13, at least 14, at least 15, at least 20, at least 25, at least 30, at least 40, at least 50, and, most preferably, between about 15 to about 30 amino acids contained within the amino acid sequence of a B Lymphocyte Stimulator polypeptide. Preferred polypeptides comprising immunogenic or antigenic epitopes are at least 10, 15, 20, 25, 30, 35, 40, 45, 50, 55, 60, 65, 70, 75, 80, 85, 90, 95, or 100 amino acid residues in length. Additional non-exclusive preferred antigenic epitopes include the antigenic epitopes disclosed herein, as well as portions thereof.

Non-limiting examples of antigenic polypeptides or peptides that can be used to generate B Lymphocyte Stimulator-specific antibodies and which may be bound by the antibodies of the invention include: a polypeptide comprising, or alternatively consisting of, amino acid residues from about Phe-115 to about Leu-147 in SEQ ID NO:3228; a polypeptide comprising, or alternatively consisting of, amino acid residues from about Ile-150 to about Tyr-163 in SEQ ID NO:3228; a polypeptide comprising, or alternatively consisting of, amino acid residues from about Ser-171 to about Phe-194 in SEQ ID NO:3228; a polypeptide comprising, or alternatively consisting of, amino acid residues from about Glu-223 to about Tyr-246 in SEQ ID NO:3228; and a polypeptide comprising, or alternatively consisting of, amino acid residues from about Ser-271 to about Phe-278 in FIGS. 1A and 1B (SEQ ID NO:3228). In this context, "about" means the particularly recited ranges and ranges larger or smaller by several, a few, 5, 4, 3, 2 or 1 amino acid residues at either or both the amino- and carboxy-termini. These polypeptide fragments have been determined to bear antigenic epitopes of the B Lymphocyte Stimulator polypeptide by the analysis of the Jameson-Wolf antigenic index, as disclosed Table 9, above.

Non-limiting examples of antigenic polypeptides or peptides that can be used to generate B Lymphocyte Stimulator-specific antibodies and which may be bound by the antibodies of the invention include: a polypeptide comprising, or alternatively consisting of, amino acid residues from about Pro-32 to about Leu-47 in SEQ ID NO:3229; a polypeptide comprising, or alternatively consisting of, amino acid residues from about Glu-116 to about Ser-143 in SEQ ID NO:3229; a polypeptide comprising, or alternatively consisting of, amino acid residues from about Phe-153 to about Tyr-173 in SEQ ID NO:3229; a polypeptide comprising, or alternatively consisting of, amino acid residues from about Pro-218 to about Tyr-227 in SEQ ID NO:3229; a polypeptide comprising, or alternatively consisting of, amino acid residues from about Ala-232 to about Gln-241 in SEQ ID NO:3229; a polypeptide comprising, or alternatively consisting of, amino acid residues from about Ile-244 to about Ala-249 in SEQ ID NO:3229; and a polypeptide comprising, or alternatively consisting of, amino acid residues from about Ser-252 to about Val-257 in SEQ ID NO:3229. In this context, "about" means the particularly recited ranges and ranges larger or smaller by several, a few, 5, 4, 3, 2 or 1 amino acid residues at either or both the amino- and carboxy-termini. These polypeptide fragments have been determined to bear antigenic epitopes of the B Lymphocyte Stimulator polypeptide by the analysis of the Jameson-Wolf antigenic index, as disclosed in Table 10 generated by the Protean component of the DNA*STAR computer program (as set forth above).

B Lymphocyte Stimulator epitope-bearing peptides and polypeptides may be produced by any conventional means. See, e.g., Houghten, R. A. (1985) General method for the rapid solid-phase synthesis of large numbers of peptides: specificity of antigen-antibody interaction at the level of individual amino acids. *Proc. Natl. Acad. Sci. USA* 82:5131–5135; this "Simultaneous Multiple Peptide Synthesis (SMPS)" process is further described in U.S. Pat. No. 4,631,211 to Houghten et al. (1986).

The present invention encompasses antibodies that bind polypeptides comprising, or alternatively consisting of, an epitope of the polypeptide having an amino acid sequence of SEQ ID NO:3228, or an epitope of the polypeptide sequence encoded by a polynucleotide sequence contained in ATCC™ deposit No. 97768, or encoded by a polynucleotide that hybridizes to cDNA sequence contained in ATCC™ deposit No. 97768 (e.g., under hybridization conditions described herein).

The present invention also encompasses antibodies that bind polypeptides comprising, or alternatively consisting of, an epitope of the polypeptide having an amino acid sequence of SEQ ID NO:3229, or an epitope of the polypeptide sequence encoded by a polynucleotide sequence contained in ATCC™ deposit No. 203518, or encoded by a polynucleotide that hybridizes to the cDNA sequence contained in ATCC™ deposit No. 203518 (e.g., under hybridization conditions described herein).

The term "epitopes," as used herein, refers to portions of a polypeptide having antigenic or immunogenic activity in an animal, preferably a mammal, and most preferably in a human. In a preferred embodiment, the present invention encompasses antibodies that bind a polypeptide comprising an epitope. An "immunogenic epitope," as used herein, is defined as a portion of a protein that elicits an antibody response in an animal, as determined by any method known in the art, for example, by the methods for generating antibodies described infra. (See, for example, Geysen et al., Proc. Natl. Acad. Sci. USA 81:3998–4002 (1983)). The term "antigenic epitope," as used herein, is defined as a portion of a protein to which an antibody can immunospecifically bind its antigen as determined by any method well known in the art, for example, by the immunoassays described herein. Immunospecific binding excludes non-specific binding but does not necessarily exclude cross-reactivity with other antigens. Antigenic epitopes need not necessarily be immunogenic.

B Lymphocyte Stimulator polypeptide fragments which function as epitopes may be produced by any conventional means. (See, e.g., Houghten, Proc. Natl. Acad. Sci. USA 82:5131–5135 (1985), further described in U.S. Pat. No. 4,631,211).

In the present invention, antibodies of the present invention bind antigenic epitopes preferably containing a sequence of at least 4, at least 5, at least 6, at least 7, more preferably at least 8, at least 9, at least 10, at least 11, at least 12, at least 13, at least 14, at least 15, at least 20, at least 25, at least 30, at least 40, at least 50, and, most preferably, between about 15 to about 30 amino acids. Preferred polypeptides comprising immunogenic or antigenic epitopes that may be bound by antibodies of the present invention are at least 10, 15, 20, 25, 30, 35, 40, 45, 50, 55, 60, 65, 70, 75, 80, 85, 90, 95, or 100 amino acid residues in length. Additional non-exclusive preferred antigenic epitopes include the antigenic epitopes disclosed herein, as well as portions thereof. Antigenic epitopes are useful, for example, to raise antibodies, including monoclonal antibodies, that specifically bind the epitope. Preferred antigenic epitopes include the antigenic epitopes disclosed herein, as well as any combination of two, three, four, five or more of these antigenic epitopes. Antigenic epitopes can be used as the target molecules in immunoassays. (See, for instance, Wilson et al., Cell 37:767–778 (1984); Sutcliffe et al., Science 219:660–666 (1983)).

Similarly, immunogenic epitopes can be used, for example, to induce antibodies according to methods well known in the art. (See, for instance, Sutcliffe et al., supra; Wilson et al., supra; Chow et al., Proc. Natl. Acad. Sci. USA 82:910–914; and Bittle et al., J. Gen. Virol. 66:2347–2354 (1985). Preferred immunogenic epitopes include the immunogenic epitopes disclosed herein, as well as any combination of two, three, four, five or more of these immunogenic epitopes. The polypeptides comprising one or more immunogenic epitopes of B Lymphocyte Stimulator may be presented for eliciting an antibody response together with a carrier protein, such as an albumin, to an animal system (such as rabbit or mouse), or, if the polypeptide is of sufficient length (at least about 25 amino acids), the polypeptide may be presented without a carrier. However, immunogenic epitopes comprising as few as 8 to 10 amino acids have been shown to be sufficient to raise antibodies capable of binding to, at the very least, linear epitopes in a denatured polypeptide (e.g., in Western blotting).

Epitope-bearing B Lymphocyte Stimulator polypeptides may be used to induce antibodies according to methods well known in the art including, but not limited to, in vivo immunization, in vitro immunization, and phage display methods. See, e.g., Sutcliffe et al., supra; Wilson et al., supra, and Bittle et al., J. Gen. Virol., 66:2347–2354 (1985). If in vivo immunization is used, animals may be immunized with free peptide; however, anti-peptide antibody titer may be boosted by coupling the peptide to a macromolecular carrier, such as keyhole limpet hemocyanin (KLH) or tetanus toxoid. For instance, peptides containing cysteine residues may be coupled to a carrier using a linker such as maleimidobenzoyl-N-hydroxysuccinimide ester (MBS), while other peptides may be coupled to carriers using a more general linking agent such as glutaraldehyde. Animals such as rabbits, rats and mice are immunized with either free or carrier-coupled peptides, for instance, by intraperitoneal and/or intradermal injection of emulsions containing about 100 micrograms of peptide or carrier protein and Freund's adjuvant or any other adjuvant known for stimulating an immune response. Several booster injections may be needed, for instance, at intervals of about two weeks, to provide a useful titer of anti-peptide antibody which can be detected, for example, by ELISA assay using free peptide adsorbed to a solid surface. The titer of anti-peptide antibodies in serum from an immunized animal may be increased by selection of anti-peptide antibodies, for instance, by adsorption to the peptide on a solid support and elution of the selected antibodies according to methods well known in the art.

As one of skill in the art will appreciate, and as discussed above, the antibodies of the present invention may bind polypeptides comprising an immunogenic or antigenic epitope fused to other polypeptide sequences. For example, the B Lymphocyte Stimulator polypeptides may be fused with the constant domain of immunoglobulins (IgA, IgE, IgG, IgM), or portions thereof (CH1, CH2, CH3, or any combination thereof and portions thereof), or albumin (including but not limited to recombinant human albumin or fragments or variants thereof (see, e.g., U.S. Pat. No. 5,876,969, issued Mar. 2, 1999, EP Patent 0 413 622, and U.S. Pat. No. 5,766,883, issued Jun. 16, 1998, herein incorporated by reference in their entirety)), resulting in chimeric polypeptides. Such fusion proteins may facilitate purification and may increase half-life in vivo. This has been shown for chimeric proteins consisting of the first two domains of the human CD4-polypeptide and various domains of the constant regions of the heavy or light chains of mammalian immunoglobulins. See, e.g., EP 394,827; Traunecker et al., Nature, 331:84–86 (1988). Enhanced delivery of an antigen across the epithelial barrier to the immune system has been demonstrated for antigens (e.g., insulin) conjugated to an FcRn binding partner such as IgG or Fc fragments (see, e.g., PCT Publications WO 96/22024 and WO 99/04813). IgG Fusion proteins that have a disulfide-linked dimeric structure due to the IgG portion disulfide bonds have also been found to be more efficient in binding and neutralizing other molecules than monomeric polypeptides or fragments thereof alone. See, e.g., Fountoulakis et al., J. Biochem., 270: 3958–3964 (1995). Nucleic acids encoding the above epitopes can also be recombined with a gene of interest as an epitope tag (e.g., the hemagglutinin ("HA") tag or flag tag) to aid in detection and purification of the expressed polypeptide. For example, a system described by Janknecht et al. allows for the ready purification of non-denatured fusion proteins expressed in human cell lines (Janknecht et al., 1991, Proc. Natl. Acad. Sci. USA 88:8972–897). In this system, the gene of interest is subcloned into a vaccinia recombination plasmid such that the open reading frame of the gene is translationally fused to an amino-terminal tag consisting of six histidine residues. The tag serves as a matrix-binding domain for the fusion protein. Extracts from cells infected with the recombinant vaccinia virus are loaded onto $Ni^{2+}$ nitriloacetic acid-agarose column and histidine-tagged proteins can be selectively eluted with imidazole-containing buffers.

In another embodiment, the antibodies of the present invention bind B Lymphocyte Stimulator polypeptides and/or the epitope-bearing fragments thereof that are fused with a heterologous antigen (e.g., polypeptide, carbohydrate, phospholipid, or nucleic acid). In specific embodiments, the heterologous antigen is an immunogen.

In a more specific embodiment, the heterologous antigen is the gp120 protein of HIV, or a fragment thereof.

In another embodiment, antibodies of the present invention bind B Lymphocyte Stimulator polypeptides and/or the epitope-bearing fragments thereof that are fused with polypeptide sequences of another TNF ligand family member (or biologically active fragments or variants thereof). In a specific embodiment, the antibodies of the present invention bind B Lymphocyte Stimulator polypeptides of the present invention are fused with a CD40L polypeptide sequence. In a preferred embodiment, the CD40L polypeptide sequence is soluble.

In another embodiment, antibodies of the present invention bind mutant B Lymphocyte Stimulator polypeptides that have been generated by random mutagenesis of a polynucleotide encoding the B Lymphocyte Stimulator polypeptide, by error-prone PCR, random nucleotide insertion or other methods prior to recombination. In another embodiment, antibodies of the present invention bind one or more components, motifs, sections, parts, domains, fragments, etc., of B Lymphocyte Stimulator recombined with one or more components, motifs, sections, parts, domains, fragments, etc. of one or more heterologous molecules. In preferred embodiments, the heterologous molecules are, for example, TNF-alpha, lymphotoxin-alpha (LT-alpha, also known as TNF-beta), LT-beta (found in complex heterotrimer LT-alpha2-beta), OPGL, FasL, CD27L, CD30L, CD40L, 4-1BBL, DcR3, OX40L, TNF-gamma (International Publication No. WO 96/14328), AIM-I (International Publication No. WO 97/33899), AIM-II (International Publication No. WO 97/34911), APRIL (J. Exp. Med. 188(6): 1185–1190), endokine-alpha (International Publication No. WO 98/07880), OPG, OX40, and nerve growth factor (NGF), and soluble forms of Fas, CD30, CD27, CD40 and 4-IBB, TR2 (International Publication No. WO 96/34095), DR3 (International Publication No. WO 97/33904), DR4 (International Publication No. WO 98/32856), TR5 (International Publication No. WO 98/30693), TR6 (International Publication No. WO 98/30694), TR7 (International Publication No. WO 98/41629), TRANK, TR9 (International Publication No. WO 98/56892), TR10 (International Publication No. WO 98/54202), 312C2 (International Publication No. WO 98/06842), TR12, CAD, and v-FLIP. In further embodiments, the heterologous molecules are any member of the TNF family.

In another preferred embodiment, antibodies of the present invention bind B Lymphocyte Stimulator polypeptides of the invention (including biologically active fragments or variants thereof), that are fused with soluble APRIL polypeptides (e.g., amino acid residues 105 through 250 of SEQ ID NO:3239), or biologically active fragments or variants thereof.

To improve or alter the characteristics of B Lymphocyte Stimulator polypeptides, protein engineering may be employed. Recombinant DNA technology known to those skilled in the art can be used to create novel mutant proteins or "muteins including single or multiple amino acid substitutions, deletions, additions or fusion proteins. Such modified polypeptides can show, e.g., enhanced activity or increased stability. In addition, they may be purified in higher yields and show better solubility than the corresponding natural polypeptide, at least under certain purification and storage conditions. For instance, for many proteins, including the extracellular domain or the mature form(s) of a secreted protein, it is known in the art that one or more amino acids may be deleted from the N-terminus or C-terminus without substantial loss of biological function. For instance, Ron et al., J. Biol. Chem., 268:2984–2988 (1993) reported modified KGF proteins that had heparin binding activity even if 3, 8, or 27 amino-terminal amino acid residues were missing. Accordingly, antibodies of the present invention may bind B Lymphocyte Stimulator polypeptide mutants or variants generated by protein engineering.

In the present case, since the protein of the invention is a member of the TNF polypeptide family, deletions of N-terminal amino acids up to the Gly (G) residue at position 191 in SEQ ID NO:3228 may retain some biological activity such as, for example, the ability to stimulate lymphocyte (e.g., B cell) proliferation, differentiation, and/or activation, and cytotoxicity to appropriate target cells. Polypeptides having further N-terminal deletions including the Gly (G) residue would not be expected to retain biological activities because it is known that this residue in TNF-related polypeptides is in the beginning of the conserved domain required for biological activities. However, even if deletion of one or more amino acids from the N-terminus of a protein results in modification or loss of one or more biological functions of the protein, other functional activities may still be retained. Thus, the ability of the shortened protein to induce and/or bind to antibodies which recognize the complete or extracellular domain of the protein generally will be retained when less than the majority of the residues of the complete or extracellular domain of the protein are removed from the N-terminus. Whether a particular polypeptide lacking N-terminal residues of a complete protein retains such immunologic activities can readily be determined by routine methods described herein and otherwise known in the art.

Accordingly, the present invention further provides antibodies that bind polypeptides having one or more residues deleted from the amino terminus of the amino acid sequence of the B Lymphocyte Stimulator of SEQ ID NO:3228, up to the glycine residue at position 191 (Gly-191 residue from the amino terminus). In particular, the present invention provides antibodies that bind polypeptides comprising, or alternatively consisting of, the amino acid sequence of residues $n^1$-285 of SEQ ID NO:3228, where $n^1$ is an integer in the range of the amino acid position of amino acid residues 2–190 of the amino acid sequence in SEQ ID NO:3228. More in particular, the invention provides antibodies that bind polypeptides comprising, or alternatively consisting of, an amino acid sequence selected from the group consisting of residues 2–285, 3–285, 4–285, 5–285, 6–285, 7–285, 8–285, 9–285, 10–285, 11–285, 12–285, 13–285, 14–285, 15–285, 16–285, 17–285, 18–285, 19–285, 20–285, 21–285, 22–285, 23–285, 24–285, 25–285, 26–285, 27–285, 28–285, 29–285, 30–285, 31–285, 32–285, 33–285, 34–285, 35–285, 36–285, 37–285, 38–285, 39–285, 40–285, 41–285, 42–285, 43–285, 44–285, 45–285, 46–285, 47–285, 48–285, 49–285, 50–285, 51–285, 52–285, 53–285, 54–285, 55–285, 56–285, 57–285, 58–285, 59–285, 60–285, 61–285, 62–285, 63–285, 64–285, 65–285, 66–285, 67–285, 68–285, 69–285, 70–285, 71–285, 72–285, 73–285, 74–285, 75–285, 76–285, 77–285, 78–285, 79–285, 80–285, 81–285, 82–285, 83–285, 84–285, 85–285, 86–285, 87–285, 88–285, 89–285, 90–285, 91–285, 92–285, 93–285, 94–285, 95–285, 96–285, 97–285, 98–285, 99–285, 100–285, 101–285, 102–285, 103–285, 104–285, 105–285, 106–285, 107–285, 108–285, 109–285, 110–285, 111–285, 112–285, 113–285, 114–285, 115–285, 116–285, 117–285, 118–285, 119–285, 120–285, 121–285, 122–285, 123–285, 124–285, 125–285, 126–285, 127–285, 128–285, 129–285, 130–285, 131–285, 132–285, 133–285, 134–285, 135–285, 136–285, 137–285, 138–285, 139–285, 140–285, 141–285, 142–285, 143–285, 144–285, 145–285, 146–285, 147–285, 148–285, 149–285, 150–285, 151–285, 152–285, 153–285, 154–285, 155–285, 156–285, 157–285, 158–285, 159–285, 160–285, 161–285, 162–285, 163–285, 164–285, 165–285, 166–285, 167–285, 168–285, 169–285, 170–285, 171–285, 172–285, 173–285, 174–285, 175–285, 176–285, 177–285, 178–285, 179–285, 180–285, 181–285, 182–285, 183–285, 184–285, 185–285, 186–285, 187–285, 188–285, 189–285, and 190–285 of SEQ ID NO:3228. The present invention is also directed to antibodies that bind B Lymphocyte Stimulator polypeptides comprising, or alternatively, consisting of, a contiguous sequence of amino acid residues at least 80%, 85%, 90%, 92%, 95%, 96%, 97%, 98% or 99% identical to the amino acid sequence of B Lymphocyte Stimulator polypeptides described above.

Furthermore, since the predicted extracellular domain of the B Lymphocyte Stimulator polypeptides of the invention may itself elicit biological activity, deletions of N- and C-terminal amino acid residues from the predicted extracellular region of the polypeptide (spanning positions Gln-73 to Leu-285 of SEQ ID NO:3228) may retain some biological activity such as, for example, ligand binding, stimulation of lymphocyte (e.g., B cell) proliferation, differentiation, and/or activation, and modulation of cell replication or modulation of target cell activities. However, even if deletion of one or more amino acids from the N-terminus of the predicted extracellular domain of a B Lymphocyte Stimulator polypeptide results in modification or loss of one or more biological functions of the polypeptide, other functional activities may still be retained. Thus, the ability of the shortened polypeptides to induce and/or bind to antibodies which recognize the complete or mature or extracellular domains of the polypeptides generally will be retained when less than the majority of the residues of the complete or mature or extracellular domains of the polypeptides are removed from the N-terminus. Whether a particular polypeptide lacking N-terminal residues of a complete polypeptide retains such immunologic activities can readily be determined by routine methods described herein and otherwise known in the art.

Accordingly, the present invention further provides antibodies that bind polypeptides having one or more residues deleted from the amino terminus of the amino acid sequence of B Lymphocyte Stimulator shown in SEQ ID NO:3228, up to the glycine residue at position number 280. In particular, the present invention provides antibodies that bind polypeptides comprising, or alternatively consisting of, the amino acid sequence of residues $n^2$-285 of SEQ ID NO:3228, where $n^2$ is an integer in the range of the amino acid position of amino acid residues 73–280 in SEQ ID NO:3228, and 73 is the position of the first residue from the N-terminus of the predicted extracellular domain of the B Lymphocyte Stimulator polypeptide (disclosed in SEQ ID NO:3228). More in particular, in certain embodiments, the invention provides antibodies that bind polypeptides comprising, or alternatively consisting of, an amino acid sequence selected from the group consisting of residues of Q-73 to L-285; G-74 to L-285; D-75 to L-285; L-76 to L-285; A-77 to L-285; S-78 to L-285; L-79 to L-285; R-80 to L-285; A-81 to L-285; E-82 to L-285; L-83 to L-285; Q-84 to L-285; G-85 to L-285; H-86 to L-285; H-87 to L-285; A-88 to L-285; E-89 to L-285; K-90 to L-285; L-91 to L-285; P-92 to L-285; A-93 to L-285; G-94 to L-285; A-95 to L-285; G-96 to L-285; A-97 to L-285; P-98 to L-285; K-99 to L-285; A-100 to L-285; G-101 to L-285; L-102 to L-285; E-103 to L-285; E-104 to L-285; A-105 to L-285; P-106 to L-285; A-107 to L-285; V-108 to L-285; T-109 to L-285; A-110 to L-285; G-111 to L-285; L-112 to L-285; K-113 to L-285; I-114 to L-285; F115 to L-285; E-116 to L-285; P-117 to L-285; P-118 to L-285; A-119 to L-285; P-120 to L-285; G-121 to L-285; E-122 to L-285; G-123 to L-285; N-124 to L-285; S-125 to L-285; S-126 to L-285; Q-127 to L-285; N-128 to L-285; S-129 to L-285; R-130 to L-285; N-131 to L-285; K-132 to L-285; R-133 to L-285; A-134 to L-285; V-135 to L-285; Q-136 to L-285; G-137 to L-285; P-138 to L-285; E-139 to L-285; E-140 to L-285; T-141 to L-285; V-142 to L-285; T-143 to L-285; Q-144 to L-285; D-145 to L-285; C-146 to L-285; L-147 to L-285; Q-148 to L-285; L-149 to L-285; I-150 to L-285; A-151 to L-285; D-152 to L-285; S-153 to L-285; E-154 to L-285; T-155 to L-285; P-156 to L-285; T-157 to L-285; I-158 to L-285; Q-159 to L-285; K-160 to L-285; G-161 to L-285; S-162 to L-285; Y-163 to L-285; T-164 to L-285; F-165 to L-285; V-166 to L-285; P-167 to L-285; W-168 to L-285; L-169 to L-285; L-170 to L-285; S-171 to L-285; F-172 to L-285; K-173 to L-285; R-174 to L-285; G-175 to L-285; S-176 to L-285; A-177 to L-285; L-178 to L-285; E-179 to L-285; E-180 to L-285; K-181 to L-285; E-182 to L-285; N-183 to L-285; K-184 to L-285; I-185 to L-285; L-186 to L-285; V-187 to L-285; K-188 to L-285; E-189 to L-285; T-190 to L-285; G-191 to L-285; Y-192 to L-285; F-193 to L-285; F-194 to L-285; I-195 to L-285; Y-196 to L-285; G-197 to L-285; Q-198 to L-285; V-199 to L-285; L-200 to L-285; Y-201 to L-285; T-202 to L-285; D-203 to L-285; K-204 to L-285; T-205 to L-285; Y-206 to L-285; A-207 to L-285; M-208 to L-285; G-209 to L-285; H-210 to L-285; L-211 to L-285; I-212 to L-285; Q-213 to L-285; R-214 to L-285; K-215 to L-285; K-216 to L-285; V-217 to L-285; H-218 to L-285; V-219 to L-285; F-220 to L-285; G-221 to L-285; D-222 to L-285; E-223 to L-285; L-224 to L-285; S-225 to L-285; L-226 to L-285; V-227 to L-285; T-228 to L-285; L-229 to L-285; F-230 to L-285; R-231 to L-285; C-232 to L-285; I-233 to L-285; Q-234 to L-285; N-235 to L-285; M-236 to L-285; P-237 to L-285; E-238 to L-285; T-239 to L-285; L-240 to L-285; P-241 to L-285; N-242 to L-285; N-243 to L-285; S-244 to L-285; C-245 to L-285; Y-246 to L-285; S-247 to L-285; A-248 to L-285; G-249 to L-285; I-250 to L-285; A-251 to L-285; K-252 to L-285; L-253 to L-285; E-254 to L-285; E-255 to L-285; G-256 to L-285; D-257 to L-285;

E-258 to L-285; L-259 to L-285; Q-260 to L-285; L-261 to L-285; A-262 to L-285; I-263 to L-285; P-264 to L-285; R-265 to L-285; E-266 to L-285; N-267 to L-285; A-268 to L-285; Q-269 to L-285; I-270 to L-285; S-271 to L-285; L-272 to L-285; D-273 to L-285; G-274 to L-285; D-275 to L-285; V-276 to L-285; T-277 to L-285; F-278 to L-285; F-279 to L-285; and G-280 to L-285 of SEQ ID NO:3228. The present invention is also directed to antibodies that bind B Lymphocyte Stimulator polypeptides comprising, or alternatively, consisting of, a contiguous sequence of amino acid residues at least 80%, 85%, 90%, 92%, 95%, 96%, 97%, 98% or 99% identical to the amino acid sequence of B Lymphocyte Stimulator polypeptides described above.

Highly preferred embodiments of the invention are directed to antibodies that bind polypeptides comprising, or alternatively consisting of, a polypeptide having an amino acid sequence least 80%, 85%, 90% identical and more preferably at least 95%, 96%, 97%, 98%, 99% or 100% identical to B Lymphocyte Stimulator polypeptide having the amino acid sequence at positions 134–285 of SEQ ID NO:3228.

Preferred embodiments of the invention are directed to antibodies that bind polypeptides comprising, or alternatively consisting of, a polypeptide having an amino acid sequence at least 90% identical to a B Lymphocyte Stimulator polypeptide having the amino acid sequence at positions 134–285 of SEQ ID NO:3228. More preferred embodiments of the invention are directed to antibodies that bind polypeptides comprising, or alternatively consisting of, a polypeptide having an amino acid sequence at least 95% identical to a B Lymphocyte Stimulator polypeptide having the amino acid sequence at positions 134–285 of SEQ ID NO:3228. More preferred embodiments of the invention are directed to antibodies that bind polypeptides comprising, or alternatively consisting of, a polypeptide having an amino acid sequence at least 96% identical to a B Lymphocyte Stimulator polypeptide having the amino acid sequence at positions 134–285 of SEQ ID NO:3228.

Additionally, more preferred embodiments of the invention are directed to antibodies that bind polypeptides comprising, or alternatively consisting of, a polypeptide having an amino acid sequence at least 97% to a B Lymphocyte Stimulator polypeptide having the amino acid sequence at positions 134–285 of SEQ ID NO:3228. Additionally, more preferred embodiments of the invention are directed to antibodies that bind polypeptides comprising, or alternatively consisting of, a polypeptide having an amino acid sequence at least 98% to a B Lymphocyte Stimulator polypeptide having the amino acid sequence at positions 134–285 of SEQ ID NO:3228. Additionally, more preferred embodiments of the invention are directed to antibodies that bind polypeptides comprising, or alternatively consisting of, a polypeptide having an amino acid sequence at least 99% identical to B Lymphocyte Stimulator polypeptide having the amino acid sequence at positions 134–285 of SEQ ID NO:3228.

In specific embodiments, antibodies of the present invention bind polypeptides comprising, or alternatively consisting of, one of the following N-terminally deleted polypeptide fragments of B Lymphocyte Stimulator: amino acid residues Ala-71 through Leu-285, amino acid residues Ala-81 through Leu-285, amino acid residues Leu-112 through Leu-285, amino acid residues Ala-134 through Leu-285, amino acid residues Leu-147 through Leu-285, and amino acid residues Gly-161 through Leu-285 of SEQ ID NO:3228.

Similarly, many examples of biologically functional C-terminal deletion polypeptides are known. For instance, Interferon gamma shows up to ten times higher activities by deleting 8–10 amino acid residues from the carboxy terminus of the protein (Döbeli et al., *J. Biotechnology* 7:199–216 (1988). Since the present protein is a member of the TNF polypeptide family, deletions of C-terminal amino acids up to the leucine residue at position 284 are expected to retain most if not all biological activity such as, for example, ligand binding, the ability to stimulate lymphocyte (e.g., B cell) proliferation, differentiation, and/or activation, and modulation of cell replication. Polypeptides having deletions of up to about 10 additional C-terminal residues (i.e., up to the glycine residue at position 274) also may retain some activity such as receptor binding, although such polypeptides would lack a portion of the conserved TNF domain which extends to about Leu-284 of SEQ ID NO:3228. However, even if deletion of one or more amino acids from the C-terminus of a protein results in modification or loss of one or more biological functions of the protein, other functional activities may still be retained. Thus, the ability of the shortened protein to induce and/or bind to antibodies which recognize the complete or mature protein generally will be retained when less than the majority of the residues of the complete or mature protein are removed from the C-terminus. Whether a particular polypeptide lacking C-terminal residues of a complete protein retains such immunologic activities can readily be determined by routine methods described herein and otherwise known in the art.

Accordingly, the present invention further provides antibodies that bind polypeptides having one or more residues deleted from the carboxy terminus of the amino acid sequence of the B Lymphocyte Stimulator polypeptide of SEQ ID NO:3228, up to the glycine residue at position 274 (Gly-274). In particular, the present invention provides antibodies that bind polypeptides comprising, or alternatively consisting of, the amino acid sequence of residues 1-$m^1$ of the amino acid sequence in SEQ ID NO:3228, where $m^1$ is any integer in the range of the amino acid position of amino acid residues 274–284 in SEQ ID NO:3228. More in particular, the invention provides antibodies that bind B Lymphocyte Stimulator polypeptides comprising, or alternatively consisting of, an amino acid sequence selected from the group consisting of residues 1–274, 1–275, 1–276, 1–277, 1–278, 1–279, 1–280, 1–281, 1–282, 1–283 and 1–284 of SEQ ID NO:3228. The present invention is also directed to antibodies that bind B Lymphocyte Stimulator polypeptides comprising, or alternatively, consisting of, a contiguous sequence of amino acid residues at least 80%, 85%, 90%, 92%, 95%, 96%, 97%, 98% or 99% identical to the amino acid sequence of B Lymphocyte Stimulator polypeptides described above.

Also provided are antibodies that bind B Lymphocyte Stimulator polypeptides comprising, or alternatively consisting of, B Lymphocyte Stimulator polypeptides with one or more amino acids deleted from both the amino and the carboxyl termini, which may be described generally as having residues $n^1$-$m^1$ of SEQ ID NO:3228, where $n^1$ and $m^1$ are integers as defined above. Also included are antibodies that bind a polypeptide comprising, or alternatively consisting of, a portion of the complete B Lymphocyte Stimulator amino acid sequence encoded by the deposited cDNA clone contained in ATCC™ Accession No. 97768 where this portion excludes from 1 to 190 amino acids from the amino terminus or from 1 to 11 amino acids from the C-terminus of the complete amino acid sequence (or any combination of these N-terminal and C-terminal deletions) encoded by the cDNA clone in the deposited plasmid.

Similarly, deletions of C-terminal amino acid residues of the predicted extracellular domain of B Lymphocyte Stimulator up to the leucine residue at position 79 of SEQ ID NO:3228 may retain some biological activity, such as, for example, ligand binding, stimulation of lymphocyte (e.g., B cell) proliferation, differentiation, and/or activation, and modulation of cell replication or modulation of target cell activities. Polypeptides having further C-terminal deletions including Leu-79 of SEQ ID NO:3228 would not be expected to retain biological activities.

However, even if deletion of one or more amino acids from the C-terminus of a polypeptide results in modification or loss of one or more biological functions of the polypeptide, other functional activities may still be retained. Thus, the ability of the shortened polypeptide to induce and/or bind to antibodies which recognize the complete, mature or extracellular forms of the polypeptide generally will be retained when less than the majority of the residues of the complete, mature or extracellular forms of the polypeptide are removed from the C-terminus. Whether a particular polypeptide lacking C-terminal residues of the predicted extracellular domain retains such immunologic activities can readily be determined by routine methods described herein and otherwise known in the art.

Accordingly, the present invention further provides antibodies that bind polypeptides having one or more residues deleted from the carboxy terminus of the amino acid sequence of the predicted extracellular domain of B Lymphocyte Stimulator polypeptide shown in SEQ ID NO:3228, up to the leucine residue at position 79 of SEQ ID NO:3228. In particular, the present invention provides antibodies that bind polypeptides comprising, or alternatively consisting of, the amino acid sequence of residues 73-$m^2$ of the amino acid sequence in SEQ ID NO:3228, where $m^2$ is any integer in the range of the amino acid position of amino acid residues 79 to 285 in the amino acid sequence in SEQ ID NO:3228, and residue 78 is the position of the first residue at the C-terminus of the predicted extracellular domain of the B Lymphocyte Stimulator polypeptide (disclosed in SEQ ID NO:3228). More in particular, in certain embodiments, the invention provides antibodies that bind polypeptides comprising, or alternatively consisting of, an amino acid sequence selected from the group consisting of residues Q-73 to Leu-285; Q-73 to L-284; Q-73 to K-283; Q-73 to L-282; Q-73 to A-281; Q-73 to G-280; Q-73 to F-279; Q-73 to F-278; Q-73 to T-277; Q-73 to V-276; Q-73 to D-275; Q-73 to G-274; Q-73 to D-273; Q-73 to L-272; Q-73 to S-271; Q-73 to I-270; Q-73 to Q-269; Q-73 to A-268; Q-73 to N-267; Q-73 to E-266; Q-73 to R-265; Q-73 to P-264; Q-73 to I-263; Q-73 to A-262; Q-73 to L-261; Q-73 to Q-260; Q-73 to L-259; Q-73 to E-258; Q-73 to D-257; Q-73 to G-256; Q-73 to E-255; Q-73 to E-254; Q-73 to L-253; Q-73 to K-252; Q-73 to A-251; Q-73 to I-250; Q-73 to G-249; Q-73 to A-248; Q-73 to S-247; Q-73 to Y-246; Q-73 to C-245; Q-73 to S-244; Q-73 to N-243; Q-73 to N-242; Q-73 to P-241; Q-73 to L-240; Q-73 to T-239; Q-73 to E-238; Q-73 to P-237; Q-73 to M-236; Q-73 to N-235; Q-73 to Q-234; Q-73 to I-233; Q-73 to C-232; Q-73 to R-231; Q-73 to F-230; Q-73 to L-229; Q-73 to T-228; Q-73 to V-227; Q-73 to L-226; Q-73 to S-225; Q-73 to L-224; Q-73 to E-223; Q-73 to D-222; Q-73 to G-221; Q-73 to F-220; Q-73 to V-219; Q-73 to H-218; Q-73 to V-217; Q-73 to K-216; Q-73 to K-215; Q-73 to R-214; Q-73 to Q-213; Q-73 to I-212; Q-73 to L-211; Q-73 to H-210; Q-73 to G-209; Q-73 to M-208; Q-73 to A-207; Q-73 to Y-206; Q-73 to T-205; Q-73 to K-204; Q-73 to D-203; Q-73 to T-202; Q-73 to Y-201; Q-73 to L-200; Q-73 to V-199; Q-73 to Q-198; Q-73 to G-197; Q-73 to Y-196; Q-73 to I-195; Q-73 to F-194; Q-73 to F-193; Q-73 to Y-192; Q-73 to G-191; Q-73 to T-190; Q-73 to E-189; Q-73 to K-188; Q-73 to V-187; Q-73 to L-186; Q-73 to I-185; Q-73 to K-184; Q-73 to N-183; Q-73 to E-182; Q-73 to K-181; Q-73 to E-180; Q-73 to E-179; Q-73 to L-178; Q-73 to A-177; Q-73 to S-176; Q-73 to G-175; Q-73 to R-174; Q-73 to K-173; Q-73 to F-172; Q-73 to S-171; Q-73 to L-170; Q-73 to L-169; Q-73 to W-168; Q-73 to P-167; Q-73 to V-166; Q-73 to F-165; Q-73 to T-164; Q-73 to Y-163; Q-73 to S-162; Q-73 to G-161; Q-73 to K-160; Q-73 to Q-159; Q-73 to I-158; Q-73 to T-157; Q-73 to P-156; Q-73 to T-155; Q-73 to E-154; Q-73 to S-153; Q-73 to D-152; Q-73 to A-151; Q-73 to I-150; Q-73 to L-149; Q-73 to Q-148; Q-73 to L-147; Q-73 to C-146; Q-73 to D-145; Q-73 to Q-144; Q-73 to T-143; Q-73 to V-142; Q-73 to T-141; Q-73 to E-140; Q-73 to E-139; Q-73 to P-138; Q-73 to G-137; Q-73 to Q-136; Q-73 to V-135; Q-73 to A-134; Q-73 to R-133; Q-73 to K-132; Q-73 to N-131; Q-73 to R-130; Q-73 to S-129; Q-73 to N-128; Q-73 to Q-127; Q-73 to S-126; Q-73 to S-125; Q-73 to N-124; Q-73 to G-123; Q-73 to E-122; Q-73 to G-121; Q-73 to P-120; Q-73 to A-119; Q-73 to P-118; Q-73 to P-117; Q-73 to E-116; Q-73 to F-115; Q-73 to I-114; Q-73 to K-113; Q-73 to L-112; Q-73 to G-Ill; Q-73 to A-110; Q-73 to T-109; Q-73 to V-108; Q-73 to A-107; Q-73 to P-106; Q-73 to A-105; Q-73 to E-104; Q-73 to E-103; Q-73 to L-102; Q-73 to G-101; Q-73 to A-100; Q-73 to K-99; Q-73 to P-98; Q-73 to A-97; Q-73 to G-96; Q-73 to A-95; Q-73 to G-94; Q-73 to A-93; Q-73 to P-92; Q-73 to L-91; Q-73 to K-90; Q-73 to E-89; Q-73 to A-88; Q-73 to H-87; Q-73 to H-86; Q-73 to G-85; Q-73 to Q-84; Q-73 to L-83; Q-73 to E-82; Q-73 to A-81; Q-73 to R-80; and Q-73 to L-79 of SEQ ID NO:3228. The present invention is also directed to antibodies that bind B Lymphocyte Stimulator polypeptides comprising, or alternatively, consisting of, a contiguous sequence of amino acid residues at least 80%, 85%, 90%, 92%, 95%, 96%, 97%, 98% or 99% identical to the amino acid sequence of B Lymphocyte Stimulator polypeptides described above.

The invention also provides antibodies that bind polypeptides having one or more amino acids deleted from both the amino and the carboxyl termini of the predicted extracellular domain of B Lymphocyte Stimulator, which may be described generally as having residues $n^2$-$m^2$ of SEQ ID NO:3228 where $n^2$ and $m^2$ are integers as defined above.

In another embodiment, antibodies of the present invention bind polypeptides consisting of a portion of the extracellular domain of the B Lymphocyte Stimulator amino acid sequence encoded by the cDNA plasmid contained in the deposit having ATCC™ accession no. 97768, where this portion excludes from 1 to about 206 amino acids from the amino terminus of the extracellular domain of the amino acid sequence encoded by the cDNA plasmid contained in the deposit having ATCC™ accession no. 97768, or from 1 to about 206 amino acids from the carboxy terminus of the extracellular domain of the amino acid sequence encoded by the cDNA plasmid contained in the deposit having ATCC™ accession no. 97768, or any combination of the above amino terminal and carboxy terminal deletions, of the entire extracellular domain of the amino acid sequence encoded by the cDNA plasmid contained in the deposit having ATCC™ accession no. 97768.

As mentioned above, even if deletion of one or more amino acids from the N-terminus of a polypeptide results in modification or loss of one or more functional activities (e.g., biological activity) of the polypeptide, other functions or biological activities may still be retained. Thus, the ability of a shortened B Lymphocyte Stimulator mutein to induce and/or bind to antibodies which recognize the full-length or mature forms or the extracellular domain of the polypeptide generally will be retained when less than the majority of the residues of the full-length or mature or extracellular domain of the polypeptide are removed from the N-terminus. Whether a particular polypeptide lacking N-terminal residues of a complete polypeptide retains such immunologic activities can readily be determined by routine methods described herein and otherwise known in the art. It is not unlikely that a B Lymphocyte Stimulator mutein with a large number of deleted N-terminal amino acid residues may retain some functional (e.g., biological or immunogenic) activities. In fact, peptides composed of as few as six B Lymphocyte Stimulator amino acid residues may often evoke an immune response.

Accordingly, the present invention further provides antibodies that bind polypeptides having one or more residues deleted from the amino terminus of the predicted full-length amino acid sequence of the B Lymphocyte Stimulator shown in SEQ ID NO:3228, up to the glycine residue at position number 280 of the sequence shown SEQ ID NO:3228 and polynucleotides encoding such polypeptides. In particular, the present invention provides antibodies that bind polypeptides comprising the amino acid sequence of residues $n^3$-285 of the sequence shown in SEQ ID NO:3228, where $n^3$ is an integer in the range of the amino acid position of amino acid residues 1 to 280 of the amino acid sequence in SEQ ID NO:3228.

More in particular, the invention provides antibodies that bind polypeptides comprising, or alternatively consisting of, an amino acid sequence selected from the group consisting of residues of D-2 to L-285; D-3 to L-285; S-4 to L-285; T-5 to L-285; E-6 to L-285; R-7 to L-285; E-8 to L-285; Q-9 to L-285; S-10 to L-285; R-11 to L-285; L-12 to L-285; T-13 to L-285; S-14 to L-285; C-15 to L-285; L-16 to L-285; K-17 to L-285; K-18 to L-285; R-19 to L-285; E-20 to L-285; E-21 to L-285; M-22 to L-285; K-23 to L-285; L-24 to L-285; K-25 to L-285; E-26 to L-285; C-27 to L-285; V-28 to L-285; S-29 to L-285; I-30 to L-285; L-31 to L-285; P-32 to L-285; R-33 to L-285; K-34 to L-285; E-35 to L-285; S-36 to L-285; P-37 to L-285; S-38 to L-285; V-39 to L-285; R-40 to L-285; S-41 to L-285; S-42 to L-285; K-43 to L-285; D-44 to L-285; G-45 to L-285; K-46 to L-285; L-47 to L-285; L-48 to L-285; A-49 to L-285; A-50 to L-285; T-51 to L-285; L-52 to L-285; L-53 to L-285; L-54 to L-285; A-55 to L-285; L-56 to L-285; L-57 to L-285; S-58 to L-285; C-59 to L-285; C-60 to L-285; L-61 to L-285; T-62 to L-285; V-63 to L-285; V-64 to L-285; S-65 to L-285; F-66 to L-285; Y-67 to L-285; Q-68 to L-285; V-69 to L-285; A-70 to L-285; A-71 to L-285; L-72 to L-285; Q-73 to L-285; G-74 to L-285; D-75 to L-285; L-76 to L-285; A-77 to L-285; S-78 to L-285; L-79 to L-285; R-80 to L-285; A-81 to L-285; E-82 to L-285; L-83 to L-285; Q-84 to L-285; G-85 to L-285; H-86 to L-285; H-87 to L-285; A-88 to L-285; E-89 to L-285; K-90 to L-285; L-91 to L-285; P-92 to L-285; A-93 to L-285; G-94 to L-285; A-95 to L-285; G-96 to L-285; A-97 to L-285; P-98 to L-285; K-99 to L-285; A-100 to L-285; G-101 to L-285; L-102 to L-285; E-103 to L-285; E-104 to L-285; A-105 to L-285; P-106 to L-285; A-107 to L-285; V-108 to L-285; T-109 to L-285; A-110 to L-285; G-111 to L-285; L-112 to L-285; K-113 to L-285; I-114 to L-285; F-115 to L-285; E-116 to L-285; P-117 to L-285; P-118 to L-285; A-119 to L-285; P-120 to L-285; G-121 to L-285; E-122 to L-285; G-123 to L-285; N-124 to L-285; S-125 to L-285; S-126 to L-285; Q-127 to L-285; N-128 to L-285; S-129 to L-285; R-130 to L-285; N-131 to L-285; K-132 to L-285; R-133 to L-285; A-134 to L-285; V-135 to L-285; Q-136 to L-285; G-137 to L-285; P-138 to L-285; E-139 to L-285; E-140 to L-285; T-141 to L-285; V-142 to L-285; T-143 to L-285; Q-144 to L-285; D-145 to L-285; C-146 to L-285; L-147 to L-285; Q-148 to L-285; L-149 to L-285; I-150 to L-285; A-151 to L-285; D-152 to L-285; S-153 to L-285; E-154 to L-285; T-155 to L-285; P-156 to L-285; T-157 to L-285; I-158 to L-285; Q-159 to L-285; K-160 to L-285; G-161 to L-285; S-162 to L-285; Y-163 to L-285; T-164 to L-285; F-165 to L-285; V-166 to L-285; P-167 to L-285; W-168 to L-285; L-169 to L-285; L-170 to L-285; S-171 to L-285; F-172 to L-285; K-173 to L-285; R-174 to L-285; G-175 to L-285; S-176 to L-285; A-177 to L-285; L-178 to L-285; E-179 to L-285; E-180 to L-285; K-181 to L-285; E-182 to L-285; N-183 to L-285; K-184 to L-285; I-185 to L-285; L-186 to L-285; V-187 to L-285; K-188 to L-285; E-189 to L-285; T-190 to L-285; G-191 to L-285; Y-192 to L-285; F-193 to L-285; F-194 to L-285; I-195 to L-285; Y-196 to L-285; G-197 to L-285; Q-198 to L-285; V-199 to L-285; L-200 to L-285; Y-201 to L-285; T-202 to L-285; D-203 to L-285; K-204 to L-285; T-205 to L-285; Y-206 to L-285; A-207 to L-285; M-208 to L-285; G-209 to L-285; H-210 to L-285; L-211 to L-285; I-212 to L-285; Q-213 to L-285; R-214 to L-285; K-215 to L-285; K-216 to L-285; V-217 to L-285; H-218 to L-285; V-219 to L-285; F-220 to L-285; G-221 to L-285; D-222 to L-285; E-223 to L-285; L-224 to L-285; S-225 to L-285; L-226 to L-285; V-227 to L-285; T-228 to L-285; L-229 to L-285; F-230 to L-285; R-231 to L-285; C-232 to L-285; I-233 to L-285; Q-234 to L-285; N-235 to L-285; M-236 to L-285; P-237 to L-285; E-238 to L-285; T-239 to L-285; L-240 to L-285; P-241 to L-285; N-242 to L-285; N-243 to L-285; S-244 to L-285; C-245 to L-285; Y-246 to L-285; S-247 to L-285; A-248 to L-285; G-249 to L-285; I-250 to L-285; A-251 to L-285; K-252 to L-285; L-253 to L-285; E-254 to L-285; E-255 to L-285; G-256 to L-285; D-257 to L-285; E-258 to L-285; L-259 to L-285; Q-260 to L-285; L-261 to L-285; A-262 to L-285; I-263 to L-285; P-264 to L-285; R-265 to L-285; E-266 to L-285; N-267 to L-285; A-268 to L-285; Q-269 to L-285; I-270 to L-285; S-271 to L-285; L-272 to L-285; D-273 to L-285; G-274 to L-285; D-275 to L-285; V-276 to L-285; T-277 to L-285; F-278 to L-285; F-279 to L-285; and G-280 to L-285 of SEQ ID NO:3228. The present invention is also directed to antibodies that bind B Lymphocyte Stimulator polypeptides comprising, or alternatively, consisting of, a contiguous sequence of amino acid residues at least 80%, 85%, 90%, 92%, 95%, 96%, 97%, 98% or 99% identical to the amino acid sequence of B Lymphocyte Stimulator polypeptides described above.

Also as mentioned above, even if deletion of one or more amino acids from the C-terminus of a protein results in modification or loss of one or more functional activities (e.g., biological activity) of the protein, other functional activities may still be retained. Thus, the ability of a shortened B Lymphocyte Stimulator mutein to induce and/or bind to antibodies which recognize the complete or mature form or the extracellular domain of the polypeptide generally will be retained when less than the majority of the residues of the complete or mature form or the extracellular domain of the polypeptide are removed from the C-terminus. Whether a particular polypeptide lacking C-terminal residues of a complete polypeptide retains such immunologic activities can readily be determined by routine methods described herein and otherwise known in the art. It is not unlikely that a B Lymphocyte Stimulator mutein with a large number of deleted C-terminal amino acid residues may retain some functional (e.g., biological or immunogenic) activities. In fact, peptides composed of as few as six B Lymphocyte Stimulator amino acid residues may often evoke an immune response.

Accordingly, the present invention further provides in another embodiment, antibodies that bind polypeptides having one or more residues deleted from the carboxy terminus of the amino acid sequence of the B Lymphocyte Stimulator shown in SEQ ID NO:3228, up to the glutamic acid residue at position number 6, and polynucleotides encoding such polypeptides. In particular, the present invention provides antibodies that bind polypeptides comprising the amino acid sequence of residues 1-$m^3$ of SEQ ID NO:3228, where $m^3$ is an integer in the range of the amino acid position of amino acid residues 6–284 of the amino acid sequence in SEQ ID NO:3228.

More in particular, the invention provides antibodies that bind polypeptides comprising, or alternatively consisting of, an amino acid sequence selected from the group consisting of residues M-1 to L-284; M-1 to K-283; M-1 to L-282; M-1 to A-281; M-1 to G-280; M-1 to F-279; M-1 to F-278; M-1 to T-277; M-1 to V-276; M-1 to D-275; M-1 to G-274; M-1 to D-273; M-1 to L-272; M-1 to S-271; M-1 to I-270; M-1 to Q-269; M-1 to A-268; M-1 to N-267; M-1 to E-266; M-1 to R-265; M-1 to P-264; M-1 to I-263; M-1 to A-262; M-1 to L-261; M-1 to Q-260; M-1 to L-259; M-1 to E-258; M-1 to D-257; M-1 to G-256; M-1 to E-255; M-1 to E-254; M-1 to L-253; M-1 to K-252; M-1 to A-251; M-1 to I-250; M-1 to G-249; M-1 to A-248; M-1 to S-247; M-1 to Y-246; M-1 to C-245; M-1 to S-244; M-1 to N-243; M-1 to N-242; M-1 to P-241; M-1 to L-240; M-1 to T-239; M-1 to E-238; M-1 to P-237; M-1 to M-236; M-1 to N-235; M-1 to Q-234; M-1 to I-233; M-1 to C-232; M-1 to R-231; M-1 to F-230; M-1 to L-229; M-1 to T-228; M-1 to V-227; M-1 to L-226; M-1 to S-225; M-1 to L-224; M-1 to E-223; M-1 to D-222; M-1 to G-221; M-1 to F-220; M-1 to V-219; M-1 to H-218; M-1 to V-217; M-1 to K-216; M-1 to K-215; M-1 to R-214; M-1 to Q-213; M-1 to I-212; M-1 to L-211; M-1 to H-210; M-1 to G-209; M-1 to M-208; M-1 to A-207; M-1 to Y-206; M-1 to T-205; M-1 to K-204; M-1 to D-203; M-1 to T-202; M-1 to Y-201; M-1 to L-200; M-1 to V-199; M-1 to Q-198; M-1 to G-197; M-1 to Y-196; M-1 to I-195; M-1 to F-194; M-1 to F-193; M-1 to Y-192; M-1 to G-191; M-1 to T-190; M-1 to E-189; M-1 to K-188; M-1 to V-187; M-1 to L-186; M-1 to I-185; M-1 to K-184; M-1 to N-183; M-1 to E-182; M-1 to K-181; M-1 to E-180; M-1 to E-179; M-1 to L-178; M-1 to A-177; M-1 to S-176; M-1 to G-175; M-1 to R-174; M-1 to K-173; M-1 to F-172; M-1 to S-171; M-1 to L-170; M-1 to L-169; M-1 to W-168; M-1 to P-167; M-1 to V-166; M-1 to F-165; M-1 to T-164; M-1 to Y-163; M-1 to S-162; M-1 to G-161; M-1 to K-160; M-1 to Q-159; M-1 to I-158; M-1 to T-157; M-1 to P-156; M-1 to T-155; M-1 to E-154; M-1 to S-153; M-1 to D-152; M-1 to A-151; M-1 to I-150; M-1 to L-149; M-1 to Q-148; M-1 to L-147; M-1 to C-146; M-1 to D-145; M-1 to Q-144; M-1 to T-143; M-1 to V-142; M-1 to T-141; M-1 to E-140; M-1 to E-139; M-1 to P-138; M-1 to G-137; M-1 to Q-136; M-1 to V-135; M-1 to A-134; M-1 to R-133; M-1 to K-132; M-1 to N-131; M-1 to R-130; M-1 to S-129; M-1 to N-128; M-1 to Q-127; M-1 to S-126; M-1 to S-125; M-1 to N-124; M-1 to G-123; M-1 to E-122; M-1 to G-121; M-1 to P-120; M-1 to A-119; M-1 to P-118; M-1 to P-117; M-1 to E-116; M-1 to F-115; M-1 to I-114; M-1 to K-113; M-1 to L-112; M-1 to G-111; M-1 to A-110; M-1 to T-109; M-1 to V-108; M-1 to A-107; M-1 to P-106; M-1 to A-105; M-1 to E-104; M-1 to E-103; M-1 to L-102; M-1 to G-101; M-1 to A-100; M-1 to K-99; M-1 to P-98; M-1 to A-97; M-1 to G-96; M-1 to A-95; M-1 to G-94; M-1 to A-93; M-1 to P-92; M-1 to L-91; M-1 to K-90; M-1 to E-89; M-1 to A-88; M-1 to H-87; M-1 to H-86; M-1 to G-85; M-1 to Q-84; M-1 to L-83; M-1 to E-82; M-1 to A-81; M-1 to R-80; M-1 to L-79; M-1 to S-78; M-1 to A-77; M-1 to L-76; M-1 to D-75; M-1 to G-74; M-1 to Q-73; M-1 to L-72; M-1 to A-71; M-1 to A-70; M-1 to V-69; M-1 to Q-68; M-1 to Y-67; M-1 to F-66; M-1 to S-65; M-1 to V-64; M-1 to V-63; M-1 to T-62; M-1 to L-61; M-1 to C-60; M-1 to C-59; M-1 to S-58; M-1 to L-57; M-1 to L-56; M-1 to A-55; M-1 to L-54; M-1 to L-53; M-1 to L-52; M-1 to T-51; M-1 to A-50; M-1 to A-49; M-1 to L-48; M-1 to L-47; M-1 to K-46; M-1 to G-45; M-1 to D-44; M-1 to K-43; M-1 to S-42; M-1 to S-41; M-1 to R-40; M-1 to V-39; M-1 to S-38; M-1 to P-37; M-1 to S-36; M-1 to E-35; M-1 to K-34; M-1 to R-33; M-1 to P-32; M-1 to L-31; M-1 to I-30; M-1 to S-29; M-1 to V-28; M-1 to C-27; M-1 to E-26; M-1 to K-25; M-1 to L-24; M-1 to K-23; M-1 to M-22; M-1 to E-21; M-1 to E-20; M-1 to R-19; M-1 to K-18; M-1 to K-17; M-1 to L-16; M-1 to C-15; M-1 to S-14; M-1 to T-13; M-1 to L-12; M-1 to R-11; M-1 to S-10; M-1 to Q-9; M-1 to E-8; M-1 to R-7; and M-1 to E-6 of SEQ ID NO:3228. The present invention is also directed to antibodies that bind B Lymphocyte Stimulator polypeptides comprising, or alternatively, consisting of, a contiguous sequence of amino acid residues at least 80%, 85%, 90%, 92%, 95%, 96%, 97%, 98% or 99% identical to the amino acid sequence of B Lymphocyte Stimulator polypeptides described above.

The invention also provides antibodies that bind polypeptides having one or more amino acids deleted from both the amino and the carboxyl termini of a B Lymphocyte Stimulator polypeptide, which may be described generally as having residues $n^3$-$m^3$ of SEQ ID NO:3228, where $n^3$ and $m^3$ are integers as defined above.

Furthermore, since the predicted extracellular domain of the B Lymphocyte Stimulator polypeptide of SEQ ID NO:3229 may itself elicit functional activity (e.g., biological activity), deletions of N- and C-terminal amino acid residues from the predicted extracellular region of the polypeptide at positions Gln-73 to Leu-266 of SEQ ID NO:3229 may retain some functional activity, such as, for example, ligand binding, to stimulation of lymphocyte (e.g., B cell) proliferation, differentiation, and/or activation, modulation of cell replication, modulation of target cell activities and/or immunogenicity. However, even if deletion of one or more amino acids from the N-terminus of the predicted extracellular domain of a B Lymphocyte Stimulator polypeptide results in modification or loss of one or more functional activities of the polypeptide, other functional activities may still be retained. Thus, the ability of the shortened polypeptides to induce and/or bind to antibodies which recognize the complete or mature or extracellular domains of the polypeptides generally will be retained when less than the majority of the residues of the complete or mature or extracellular domains of the polypeptides are removed from the N-terminus. Whether a particular polypeptide lacking N-terminal residues of a complete polypeptide retains such immunologic activities can readily be determined by routine methods described herein and otherwise known in the art.

Accordingly, the present invention further provides antibodies that bind polypeptides having one or more residues deleted from the amino terminus of the amino acid sequence of B Lymphocyte Stimulator shown in SEQ ID NO:3229, up to the glycine residue at position number 261. In particular, the present invention provides antibodies that bind polypeptides comprising the amino acid sequence of residues $n^4$-266 of SEQ ID NO:3229, where $n^4$ is an integer in the range of the amino acid position of amino acid residues 73–261 of the amino acid sequence in SEQ ID NO:3229, and 261 is the position of the first residue from the N-terminus of the predicted extracellular domain B Lymphocyte Stimulator polypeptide (shown in SEQ ID NO:3229).

More in particular, in certain embodiments, the invention provides antibodies that bind polypeptides comprising, or alternatively consisting of, an amino acid sequence selected from the group consisting of residues of Q-73 to L-266; G-74 to L-266; D-75 to L-266; L-76 to L-266; A-77 to L-266; S-78 to L-266; L-79 to L-266; R-80 to L-266; A-81 to L-266; E-82 to L-266; L-83 to L-266; Q-84 to L-266; G-85 to L-266; H-86 to L-266; H-87 to L-266; A-88 to L-266; E-89 to L-266; K-90 to L-266; L-91 to L-266; P-92 to L-266; A-93 to L-266; G-94 to L-266; A-95 to L-266; G-96 to L-266; A-97 to L-266; P-98 to L-266; K-99 to L-266; A-100 to L-266; G-101 to L-266; L-102 to L-266; E-103 to L-266; E-104 to L-266; A-105 to L-266; P-106 to L-266; A-107 to L-266; V-108 to L-266; T-109 to L-266; A-110 to L-266; G-111 to L-266; L-112 to L-266; K-113 to L-266; I-114 to L-266; F-115 to L-266; E-116 to L-266; P-117 to L-266; P-118 to L-266; A-119 to L-266; P-120 to L-266; G-121 to L-266; E-122 to L-266; G-123 to L-266; N-124 to L-266; S-125 to L-266; S-126 to L-266; Q-127 to L-266; N-128 to L-266; S-129 to L-266; R-130 to L-266; N-131 to L-266; K-132 to L-266; R-133 to L-266; A-134 to L-266; V-135 to L-266; Q-136 to L-266; G-137 to L-266; P-138 to L-266; E-139 to L-266; E-140 to L-266; T-141 to L-266; G-142 to L-266; S-143 to L-266; Y-144 to L-266; T-145 to L-266; F-146 to L-266; V-147 to L-266; P-148 to L-266; W-149 to L-266; L-150 to L-266; L-151 to L-266; S-152 to L-266; F-153 to L-266; K-154 to L-266; R-155 to L-266; G-156 to L-266; S-157 to L-266; A-158 to L-266; L-159 to L-266; E-160 to L-266; E-161 to L-266; K-162 to L-266; E-163 to L-266; N-164 to L-266; K-165 to L-266; I-166 to L-266; L-167 to L-266; V-168 to L-266; K-169 to L-266; E-170 to L-266; T-171 to L-266; G-172 to L-266; Y-173 to L-266; F-174 to L-266; F-175 to L-266; I-176 to L-266; Y-177 to L-266; G-178 to L-266; Q-179 to L-266; V-180 to L-266; L-181 to L-266; Y-182 to L-266; T-183 to L-266; D-184 to L-266; K-185 to L-266; T-186 to L-266; Y-187 to L-266; A-188 to L-266; M-189 to L-266; G-190 to L-266; H-191 to L-266; L-192 to L-266; I-193 to L-266; Q-194 to L-266; R-195 to L-266; K-196 to L-266; K-197 to L-266; V-198 to L-266; H-199 to L-266; V-200 to L-266; F-201 to L-266; G-202 to L-266; D-203 to L-266; E-204 to L-266; L-205 to L-266; S-206 to L-266; L-207 to L-266; V-208 to L-266; T-209 to L-266; L-210 to L-266; F-211 to L-266; R-212 to L-266; C-213 to L-266; I-214 to L-266; Q-215 to L-266; N-216 to L-266; M-217 to L-266; P-218 to L-266; E-219 to L-266; T-220 to L-266; L-221 to L-266; P-222 to L-266; N-223 to L-266; N-224 to L-266; S-225 to L-266; C-226 to L-266; Y-227 to L-266; S-228 to L-266; A-229 to L-266; G-230 to L-266; I-231 to L-266; A-232 to L-266; K-233 to L-266; L-234 to L-266; E-235 to L-266; E-236 to L-266; G-237 to L-266; D-238 to L-266; E-239 to L-266; L-240 to L-266; Q-241 to L-266; L-242 to L-266; A-243 to L-266; I-244 to L-266; P-245 to L-266; R-246 to L-266; E-247 to L-266; N-248 to L-266; A-249 to L-266; Q-250 to L-266; I-251 to L-266; S-252 to L-266; L-253 to L-266; D-254 to L-266; G-255 to L-266; D-256 to L-266; V-257 to L-266; T-258 to L-266; F-259 to L-266; F-260 to L-266; and G-261 to L-266 of SEQ ID NO:3229. The present invention is also directed to antibodies that bind B Lymphocyte Stimulator polypeptides comprising, or alternatively, consisting of, a contiguous sequence of amino acid residues at least 80%, 85%, 90%, 92%, 95%, 96%, 97%, 98% or 99% identical to the amino acid sequence of B Lymphocyte Stimulator polypeptides described above.

Similarly, deletions of C-terminal amino acid residues of the predicted extracellular domain of B Lymphocyte Stimulator up to the leucine residue at position 79 of SEQ ID NO:3229 may retain some functional activity, such as, for example, ligand binding, the ability to stimulate lymphocyte (e.g., B cell) proliferation, differentiation, and/or activation, modulation of cell replication, modulation of target cell activities and/or immunogenicity. Polypeptides having further C-terminal deletions including Leu-79 of SEQ ID NO:3229 would not be expected to retain biological activities.

However, even if deletion of one or more amino acids from the C-terminus of a polypeptide results in modification or loss of one or more functional activities (e.g., biological activity) of the polypeptide, other functional activities may still be retained. Thus, the ability of the shortened polypeptide to induce and/or bind to antibodies which recognize the complete, mature or extracellular forms of the polypeptide generally will be retained when less than the majority of the residues of the complete, mature or extracellular forms of the polypeptide are removed from the C-terminus. Whether a particular polypeptide lacking C-terminal residues of the predicted extracellular domain retains such immunologic activities can readily be determined by routine methods described herein and otherwise known in the art.

Accordingly, the present invention further provides antibodies that bind polypeptides having one or more residues from the carboxy terminus of the amino acid sequence of the predicted extracellular domain of B Lymphocyte Stimulator shown in SEQ ID NO:3229, up to the leucine residue at position 79 of SEQ ID NO:3229. In particular, the present invention provides antibodies that bind polypeptides having the amino acid sequence of residues 73-$m^4$ of the amino acid sequence in SEQ ID NO:3229, where $m^4$ is any integer in the range of the amino acid position of amino acid residues 79–265 of the amino acid sequence in SEQ ID NO:3229.

More in particular, in certain embodiments, the invention provides antibodies that bind polypeptides comprising, or alternatively consisting of, an amino acid sequence selected from the group consisting of residues Q-73 to L-265; Q-73 to K-264; Q-73 to L-263; Q-73 to A-262; Q-73 to G-261; Q-73 to F-260; Q-73 to F-259; Q-73 to T-258; Q-73 to V-257; Q-73 to D-256; Q-73 to G-255; Q-73 to D-254; Q-73 to L-253; Q-73 to S-252; Q-73 to I-251; Q-73 to Q-250; Q-73 to A-249; Q-73 to N-248; Q-73 to E-247; Q-73 to R-246; Q-73 to P-245; Q-73 to I-244; Q-73 to A-243; Q-73 to L-242; Q-73 to Q-241; Q-73 to L-240; Q-73 to E-239; Q-73 to D-238; Q-73 to G-237; Q-73 to E-236; Q-73 to E-235; Q-73 to L-234; Q-73 to K-233; Q-73 to A-232; Q-73 to I-231; Q-73 to G-230; Q-73 to A-229; Q-73 to S-228; Q-73 to Y-227; Q-73 to C-226; Q-73 to S-225; Q-73 to N-224; Q-73 to N-223; Q-73 to P-222; Q-73 to L-221; Q-73 to T-220; Q-73 to E-219; Q-73 to P-218; Q-73 to M-217; Q-73 to N-216; Q-73 to Q-215; Q-73 to I-214; Q-73 to C-213; Q-73 to R-212; Q-73 to F-211; Q-73 to L-210; Q-73 to T-209; Q-73 to V-208; Q-73 to L-207; Q-73 to S-206; Q-73 to L-205; Q-73 to E-204; Q-73 to D-203; Q-73 to G-202; Q-73 to F-201; Q-73 to V-200; Q-73 to H-199; Q-73 to V-198; Q-73 to K-197; Q-73 to K-196; Q-73 to R-195; Q-73 to Q-194; Q-73 to I-193; Q-73 to L-192; Q-73 to H-191; Q-73 to G-190; Q-73 to Q-7389; Q-73 to A-188; Q-73 to Y-187; Q-73 to T-186; Q-73 to K-185; Q-73 to D-184; Q-73 to T-183; Q-73 to Y-182; Q-73 to L-181; Q-73 to V-180; Q-73 to Q-179; Q-73 to G-178; Q-73 to Y-177;

Q-73 to I-176; Q-73 to F-175; Q-73 to F-174; Q-73 to Y-173; Q-73 to G-172; Q-73 to T-171; Q-73 to E-170; Q-73 to K-169; Q-73 to V-168; Q-73 to L-167; Q-73 to I-166; Q-73 to K-165; Q-73 to N-164; Q-73 to E-163; Q-73 to K-162; Q-73 to E-161; Q-73 to E-160; Q-73 to L-159; Q-73 to A-158; Q-73 to S-157; Q-73 to G-156; Q-73 to R-155; Q-73 to K-154; Q-73 to F-153; Q-73 to S-152; Q-73 to L-151; Q-73 to L-150; Q-73 to W-149; Q-73 to P-148; Q-73 to V-147; Q-73 to F-146; Q-73 to T-145; Q-73 to Y-144; Q-73 to S-143; Q-73 to G-142; Q-73 to T-141; Q-73 to E-140; Q-73 to E-139; Q-73 to P-138; Q-73 to G-137; Q-73 to Q-136; Q-73 to V-135; Q-73 to A-134; Q-73 to R-133; Q-73 to K-132; Q-73 to N-131; Q-73 to R-130; Q-73 to S-129; Q-73 to N-128; Q-73 to Q-127; Q-73 to S-126; Q-73 to S-125; Q-73 to N-124; Q-73 to G-123; Q-73 to E-122; Q-73 to G-121; Q-73 to P-120; Q-73 to A-119; Q-73 to P-118; Q-73 to P-117; Q-73 to E-116; Q-73 to F-115; Q-73 to I-114; Q-73 to K-113; Q-73 to L-112; Q-73 to G-111; Q-73 to A-110; Q-73 to T-109; Q-73 to V-108; Q-73 to A-107; Q-73 to P-106; Q-73 to A-105; Q-73 to E-104; Q-73 to E-103; Q-73 to L-102; Q-73 to G-101; Q-73 to A-100; Q-73 to K-99; Q-73 to P-98; Q-73 to A-97; Q-73 to G-96; Q-73 to A-95; Q-73 to G-94; Q-73 to A-93; Q-73 to P-92; Q-73 to L-91; Q-73 to K-90; Q-73 to E-89; Q-73 to A-88; Q-73 to H-87; Q-73 to H-86; Q-73 to G-85; Q-73 to Q-84; Q-73 to L-83; Q-73 to E-82; Q-73 to A-81; Q-73 to R-80; Q-73 to L-79; and Q-73 to S-78 of SEQ ID NO:3229. The present invention is also directed to antibodies that bind B Lymphocyte Stimulator polypeptides comprising, or alternatively, consisting of, a contiguous sequence of amino acid residues at least 80%, 85%, 90%, 92%, 95%, 96%, 97%, 98% or 99% identical to the amino acid sequence of B Lymphocyte Stimulator polypeptides described above.

The invention also provides polypeptides having one or more amino acids deleted from both the amino and the carboxyl termini of the predicted extracellular domain of B Lymphocyte Stimulator, which may be described generally as having residues $n^4$-$m^4$ of SEQ ID NO:3229 where $n^4$ and $m^4$ are integers as defined above.

In another embodiment, antibodies of the present invention bind polypeptides consisting of a portion of the extracellular domain of the B Lymphocyte Stimulator amino acid sequence encoded by the cDNA clone contained in the deposit having ATCC™ Accession No. 203518, where this portion excludes from 1 to about 260 amino acids from the amino terminus of the extracellular domain of the amino acid sequence encoded by cDNA clone contained in the deposit having ATCC™ Accession No. 203518, or from 1 to about 187 amino acids from the carboxy terminus of the extracellular domain of the amino acid sequence encoded by cDNA clone contained in the deposit having ATCC™ Accession No. 203518, or any combination of the above amino terminal and carboxy terminal deletions, of the entire extracellular domain of the amino acid sequence encoded by the cDNA clone contained in the deposit having ATCC™ Accession No. 203518.

As mentioned above, even if deletion of one or more amino acids from the N-terminus of a polypeptide results in modification or loss of one or more functional activities (e.g., biological activity) of the polypeptide, other functional activities may still be retained. Thus, the ability of a shortened B Lymphocyte Stimulator polypeptide to induce and/or bind to antibodies which recognize the full-length or mature forms or the extracellular domain of the polypeptide generally will be retained when less than the majority of the residues of the full-length or mature or extracellular domain of the polypeptide are removed from the N-terminus. Whether a particular polypeptide lacking N-terminal residues of a complete polypeptide retains such immunologic activities can readily be determined by routine methods described herein and otherwise known in the art. It is not unlikely that a B Lymphocyte Stimulator mutein with a large number of deleted N-terminal amino acid residues may retain functional (e.g., immunogenic) activities. In fact, peptides composed of as few as six B Lymphocyte Stimulator amino acid residues may often evoke an immune response.

Accordingly, the present invention further provides antibodies that bind polypeptides having one or more residues deleted from the amino terminus of the predicted full-length amino acid sequence of the B Lymphocyte Stimulator polypeptide shown in SEQ ID NO:3229, up to the glycine residue at position number 261 of the sequence shown SEQ ID NO:3229 and polynucleotides encoding such polypeptides. In particular, the present invention provides antibodies that bind polypeptides comprising the amino acid sequence of residues $n^5$-266 of the sequence shown in SEQ ID NO:3229, where $n^5$ is an integer in the range of the amino acid position of amino acid residues 1 to 261 of the amino acid sequence in SEQ ID NO:3229.

More in particular, the invention provides antibodies that bind polypeptides comprising, or alternatively consisting of, an amino acid sequence selected from the group consisting of residues of D-2 to L-266; D-3 to L-266; S-4 to L-266; T-5 to L-266; E-6 to L-266; R-7 to L-266; E-8 to L-266; Q-9 to L-266; S-10 to L-266; R-11 to L-266; L-12 to L-266; T-13 to L-266; S-14 to L-266; C-15 to L-266; L-16 to L-266; K-17 to L-266; K-18 to L-266; R-19 to L-266; E-20 to L-266; E-21 to L-266; M-22 to L-266; K-23 to L-266; L-24 to L-266; K-25 to L-266; E-26 to L-266; C-27 to L-266; V-28 to L-266; S-29 to L-266; I-30 to L-266; L-31 to L-266; P-32 to L-266; R-33 to L-266; K-34 to L-266; E-35 to L-266; S-36 to L-266; P-37 to L-266; S-38 to L-266; V-39 to L-266; R-40 to L-266; S-41 to L-266; S-42 to L-266; K-43 to L-266; D-44 to L-266; G-45 to L-266; K-46 to L-266; L-47 to L-266; L-48 to L-266; A-49 to L-266; A-50 to L-266; T-51 to L-266; L-52 to L-266; L-53 to L-266; L-54 to L-266; A-55 to L-266; L-56 to L-266; L-57 to L-266; S-58 to L-266; C-59 to L-266; C-60 to L-266; L-61 to L-266; T-62 to L-266; V-63 to L-266; V-64 to L-266; S-65 to L-266; F-66 to L-266; Y-67 to L-266; Q-68 to L-266; V-69 to L-266; A-70 to L-266; A-71 to L-266; L-72 to L-266; Q-73 to L-266; G-74 to L-266; D-75 to L-266; L-76 to L-266; A-77 to L-266; S-78 to L-266; L-79 to L-266; R-80 to L-266; A-81 to L-266; E-82 to L-266; L-83 to L-266; Q-84 to L-266; G-85 to L-266; H-86 to L-266; H-87 to L-266; A-88 to L-266; E-89 to L-266; K-90 to L-266; L-91 to L-266; P-92 to L-266; A-93 to L-266; G-94 to L-266; A-95 to L-266; G-96 to L-266; A-97 to L-266; P-98 to L-266; K-99 to L-266; A-100 to L-266; G-101 to L-266; L-102 to L-266; E-103 to L-266; E-104 to L-266; A-105 to L-266; P-106 to L-266; A-107 to L-266; V-108 to L-266; T-109 to L-266; A-110 to L-266; G-111 to L-266; L-112 to L-266; K-113 to L-266; I-114 to L-266; F-115 to L-266; E-116 to L-266; P-117 to L-266; P-118 to L-266; A-119 to L-266; P-120 to L-266; G-121 to L-266; E-122 to L-266; G-123 to L-266; N-124 to L-266; S-125 to L-266; S-126 to L-266; Q-127 to L-266; N-128 to L-266; S-129 to L-266; R-130 to L-266; N-131 to L-266; K-132 to L-266; R-133 to L-266; A-134 to L-266; V-135 to L-266; Q-136 to L-266; G-137 to L-266; P-138 to L-266; E-139 to L-266; E-140 to L-266; T-141 to L-266; G-142 to L-266; S-143 to L-266; Y-144 to L-266; T-145 to L-266; F-146 to L-266; V-147 to L-266; P-148 to L-266; W-149 to L-266; L-150 to L-266; L-151 to L-266;

S-152 to L-266; F-153 to L-266; K-154 to L-266; R-155 to L-266; G-156 to L-266; S-157 to L-266; A-158 to L-266; L-159 to L-266; E-160 to L-266; E-161 to L-266; K-162 to L-266; E-163 to L-266; N-164 to L-266; K-165 to L-266; I-166 to L-266; L-167 to L-266; V-168 to L-266; K-169 to L-266; E-170 to L-266; T-171 to L-266; G-172 to L-266; Y-173 to L-266; F-174 to L-266; F-175 to L-266; I-176 to L-266; Y-177 to L-266; G-178 to L-266; Q-179 to L-266; V-180 to L-266; L-181 to L-266; Y-182 to L-266; T-183 to L-266; D-184 to L-266; K-185 to L-266; T-186 to L-266; Y-187 to L-266; A-188 to L-266; M-189 to L-266; G-190 to L-266; H-191 to L-266; L-192 to L-266; I-193 to L-266; Q-194 to L-266; R-195 to L-266; K-196 to L-266; K-197 to L-266; V-198 to L-266; H-199 to L-266; V-200 to L-266; F-201 to L-266; G-202 to L-266; D-203 to L-266; E-204 to L-266; L-205 to L-266; S-206 to L-266; L-207 to L-266; V-208 to L-266; T-209 to L-266; L-210 to L-266; F-211 to L-266; R-212 to L-266; C-213 to L-266; I-214 to L-266; Q-215 to L-266; N-216 to L-266; M-217 to L-266; P-218 to L-266; E-219 to L-266; T-220 to L-266; L-221 to L-266; P-222 to L-266; N-223 to L-266; N-224 to L-266; S-225 to L-266; C-226 to L-266; Y-227 to L-266; S-228 to L-266; A-229 to L-266; G-230 to L-266; I-231 to L-266; A-232 to L-266; K-233 to L-266; L-234 to L-266; E-235 to L-266; E-236 to L-266; G-237 to L-266; D-238 to L-266; E-239 to L-266; L-240 to L-266; Q-241 to L-266; L-242 to L-266; A-243 to L-266; I-244 to L-266; P-245 to L-266; R-246 to L-266; E-247 to L-266; N-248 to L-266; A-249 to L-266; Q-250 to L-266; I-251 to L-266; S-252 to L-266; L-253 to L-266; D-254 to L-266; G-255 to L-266; D-256 to L-266; V-257 to L-266; T-258 to L-266; F-259 to L-266; F-260 to L-266; and G-261 to L-266 of SEQ ID NO:3229. The present invention is also directed to antibodies that bind B Lymphocyte Stimulator polypeptides comprising, or alternatively, consisting of, a contiguous sequence of amino acid residues at least 80%, 85%, 90%, 92%, 95%, 96%, 97%, 98% or 99% identical to the amino acid sequence of B Lymphocyte Stimulator polypeptides described above.

Also as mentioned above, even if deletion of one or more amino acids from the C-terminus of a protein results in modification or loss of one or more functional activities (e.g., biological activities) of the protein, other functional activities may still be retained. Thus, the ability of a shortened B Lymphocyte Stimulator mutein to induce and/or bind to antibodies which recognize the complete or mature form or the extracellular domain of the polypeptide generally will be retained when less than the majority of the residues of the complete or mature form or the extracellular domain of the polypeptide are removed from the C-terminus. Whether a particular polypeptide lacking C-terminal residues of a complete polypeptide retains such immunologic activities can readily be determined by routine methods described herein and otherwise known in the art. It is not unlikely that a B Lymphocyte Stimulator mutein with a large number of deleted C-terminal amino acid residues may retain some functional (e.g., immunogenic) activities. In fact, peptides composed of as few as six B Lymphocyte Stimulator amino acid residues may often evoke an immune response.

Accordingly, the present invention further provides in another embodiment, antibodies that bind polypeptides having one or more residues deleted from the carboxy terminus of the amino acid sequence of the B Lymphocyte Stimulator shown in SEQ ID NO:3229, up to the glutamic acid residue at position number 6, and polynucleotides encoding such polypeptides. In particular, the present invention provides antibodies that bind polypeptides comprising the amino acid sequence of residues 1-$m^5$ of SEQ ID NO:3229, where $m^5$ is an integer in the range of the amino acid position of amino acid residues 6 to 265 in the amino acid sequence of SEQ ID NO:3229.

More in particular, the invention provides antibodies that bind polypeptides comprising, or alternatively consisting of, an amino acid sequence selected from the group consisting of residues M-1 to L-265; M-1 to K-264; M-1 to L-263; M-1 to A-262; M-1 to G-261; M-1 to F-260; M-1 to F-259; M-1 to T-258; M-1 to V-257; M-1 to D-256; M-1 to G-255; M-1 to D-254; M-1 to L-253; M-1 to S-252; M-1 to I-251; M-1 to Q-250; M-1 to A-249; M-1 to N-248; M-1 to E-247; M-1 to R-246; M-1 to P-245; M-1 to I-244; M-1 to A-243; M-1 to L-242; M-1 to Q-241; M-1 to L-240; M-1 to E-239; M-1 to D-238; M-1 to G-237; M-1 to E-236; M-1 to E-235; M-1 to L-234; M-1 to K-233; M-1 to A-232; M-1 to I-231; M-1 to G-230; M-1 to A-229; M-1 to S-228; M-1 to Y-227; M-1 to C-226; M-1 to S-225; M-1 to N-224; M-1 to N-223; M-1 to P-222; M-1 to L-221; M-1 to T-220; M-1 to E-219; M-1 to P-218; M-1 to M-217; M-1 to N-216; M-1 to Q-215; M-1 to I-214; M-1 to C-213; M-1 to R-212; M-1 to F-211; M-1 to L-210; M-1 to T-209; M-1 to V-208; M-1 to L-207; M-1 to S-206; M-1 to L-205; M-1 to E-204; M-1 to D-203; M-1 to G-202; M-1 to F-201; M-1 to V-200; M-1 to H-199; M-1 to V-198; M-1 to K-197; M-1 to K-196; M-1 to R-195; M-1 to Q-194; M-1 to I-193; M-1 to L-192; M-1 to H-191; M-1 to G-190; M-1 to M-189; M-1 to A-188; M-1 to Y-187; M-1 to T-186; M-1 to K-185; M-1 to D-184; M-1 to T-183; M-1 to Y-182; M-1 to L-181; M-1 to V-180; M-1 to Q-179; M-1 to G-178; M-1 to Y-177; M-1 to I-176; M-1 to F-175; M-1 to F-174; M-1 to Y-173; M-1 to G-172; M-1 to T-171; M-1 to E-170; M-1 to K-169; M-1 to V-168; M-1 to L-167; M-1 to I-166; M-1 to K-165; M-1 to N-164; M-1 to E-163; M-1 to K-162; M-1 to E-161; M-1 to E-160; M-1 to L-159; M-1 to A-158; M-1 to S-157; M-1 to G-156; M-1 to R-155; M-1 to K-154; M-1 to F-153; M-1 to S-152; M-1 to L-151; M-1 to L-150; M-1 to W-149; M-1 to P-148; M-1 to V-147; M-1 to F-146; M-1 to T-145; M-1 to Y-144; NM-1 to S-143; M-1 to G-142; M-1 to T-141; M-1 to E-140; M-1 to E-139; M-1 to P-138; M-1 to G-137; M-1 to Q-136; M-1 to V-135; M-1 to A-134; M-1 to R-133; M-1 to K-132; M-1 to N-131; M-1 to R-130; M-1 to S-129; M-1 to N-128; M-1 to Q-127; M-1 to S-126; M-1 to S-125; M-1 to N-124; M-1 to G-123; M-1 to E-122; M-1 to G-121; M-1 to P-120; M-1 to A-119; M-1 to P-118; M-1 to P-117; M-1 to E-116; M-1 to F-115; M-1 to I-114; M-1 to K-113; M-1 to L-112; M-1 to G-111; M-1 to A-110; M-1 to T-109; M-1 to V-108; M-1 to A-107; M-1 to P-106; M-1 to A-105; M-1 to E-104; M-1 to E-103; M-1 to L-102; M-1 to G-101; M-1 to A-100; M-1 to K-99; M-1 to P-98; M-1 to A-97; M-1 to G-96; M-1 to A-95; M-1 to G-94; M-1 to A-93; M-1 to P-92; M-1 to L-91; M-1 to K-90; M-1 to E-89; M-1 to A-88; M-1 to H-87; M-1 to H-86; M-1 to G-85; M-1 to Q-84; M-1 to L-83; M-1 to E-82; M-1 to A-81; M-1 to R-80; M-1 to L-79; M-1 to S-78; M-1 to A-77; M-1 to L-76; M-1 to D-75; M-1 to G-74; M-1 to Q-73; M-1 to L-72; M-1 to A-71; M-1 to A-70; M-1 to V-69; M-1 to Q-68; M-1 to Y-67; M-1 to F-66; M-1 to S-65; M-1 to V-64; M-1 to V-63; M-1 to T-62; M-1 to L-61; M-1 to C-60; M-1 to C-59; M-1 to S-58; M-1 to L-57; M-1 to L-56; M-1 to A-55; M-1 to L-54; M-1 to L-53; M-1 to L-52; M-1 to T-51; M-1 to A-50; M-1 to A-49; M-1 to L-48; M-1 to L-47; M-1 to K-46; M-1 to G-45; M-1 to D-44; M-1 to K-43; M-1 to S-42; M-1 to S-41; M-1 to R-40; M-1 to V-39; M-1 to S-38; M-1 to P-37; M-1 to S-36; M-1 to E-35; M-1 to K-34; M-1 to R-33; M-1 to P-32; M-1 to L-31; M-1 to I-30; M-1 to S-29; M-1 to V-28; M-1 to C-27; M-1 to E-26; M-1 to K-25; M-1 to L-24; M-1 to K-23; M-1 to M-22; M-1 to E-21; M-1 to E-20; M-1 to R-19; M-1 to K-18; M-1 to K-17; M-1 to L-16; M-1 to C-15; M-1 to S-14; M-1 to T-13; M-1 to L-12; M-1 to R-11; M-1 to S-10; M-1 to Q-9; M-1 to E-8; M-1 to R-7; and M-1 to E-6 of SEQ ID NO:3229. The present invention is also directed to antibodies that bind B Lymphocyte Stimulator polypeptides comprising, or alternatively, consisting of, a contiguous sequence of amino acid residues at least 80%, 85%, 90%, 92%, 95%, 96%, 97%, 98% or 99% identical to the amino acid sequence of B Lymphocyte Stimulator polypeptides described above.

The invention also provides antibodies that bind polypeptides having one or more amino acids deleted from both the amino and the carboxyl termini of a B Lymphocyte Stimulator polypeptide, which may be described generally as having residues $n^5$-$m^5$ of SEQ ID NO:3229, where $n^5$ and $m^5$ are integers as defined above.

In additional embodiments, the present invention provides antibodies that bind polypeptides comprising the amino acid sequence of residues 134-$m^6$ of SEQ ID NO:3228, where $m^6$ is an integer from 140 to 285, corresponding to the position of the amino acid residue in SEQ ID NO:3228. For example, the invention provides antibodies that bind polypeptides comprising, or alternatively consisting of, an amino acid sequence selected from the group consisting of residues A-134 to Leu-285; A-134 to L-284; A-134 to K-283; A-134 to L-282; A-134 to A-281; A-134 to G-280; A-134 to F-279; A-134 to F-278; A-134 to T-277; A-134 to V-276; A-134 to D-275; A-134 to G-274; A-134 to D-273; A-134 to L-272; A-134 to S-271; A-134 to I-270; A-134 to Q-269; A-134 to A-268; A-134 to N-267; A-134 to E-266; A-134 to R-265; A-134 to P-264; A-134 to I-263; A-134 to A-262; A-134 to L-261; A-134 to Q-260; A-134 to L-259; A-134 to E-258; A-134 to D-257; A-134 to G-256; A-134 to E-255; A-134 to E-254; A-134 to L-253; A-134 to K-252; A-134 to A-251; A-134 to I-250; A-134 to G-249; A-134 to A-248; A-134 to S-247; A-134 to Y-246; A-134 to C-245; A-134 to S-244; A-134 to N-243; A-134 to N-242; A-134 to P-241; A-134 to L-240; A-134 to T-239; A-134 to E-238; A-134 to P-237; A-134 to M-236; A-134 to N-235; A-134 to Q-234; A-134 to I-233; A-134 to C-232; A-134 to R-231; A-134 to F-230; A-134 to L-229; A-134 to T-228; A-134 to V-227; A-134 to L-226; A-134 to S-225; A-134 to L-224; A-134 to E-223; A-134 to D-222; A-134 to G-221; A-134 to F-220; A-134 to V-219; A-134 to H-218; A-134 to V-217; A-134 to K-216; A-134 to K-215; A-134 to R-214; A-134 to Q-213; A-134 to I-212; A-134 to L-211; A-134 to H-210; A-134 to G-209; A-134 to M-208; A-134 to A-207; A-134 to Y-206; A-134 to T-205; A-134 to K-204; A-134 to D-203; A-134 to T-202; A-134 to Y-201; A-134 to L-200; A-134 to V-199; A-134 to Q-198; A-134 to G-197; A-134 to Y-196; A-134 to I-195; A-134 to F-194; A-134 to F-193; A-134 to Y-192; A-134 to G-191; A-134 to T-190; A-134 to E-189; A-134 to K-188; A-134 to V-187; A-134 to L-186; A-134 to I-185; A-134 to K-184; A-134 to N-183; A-134 to E-182; A-134 to K-181; A-134 to E-180; A-134 to E-179; A-134 to L-178; A-134 to A-177; A-134 to S-176; A-134 to G-175; A-134 to R-174; A-134 to K-173; A-134 to F-172; A-134 to S-171; A-134 to L-170; A-134 to L-169; A-134 to W-168; A-134 to P-167; A-134 to V-166; A-134 to F-165; A-134 to T-164; A-134 to Y-163; A-134 to S-162; A-134 to G-161; A-134 to K-160; A-134 to Q-159; A-134 to I-158; A-134 to T-157; A-134 to P-156; A-134 to T-155; A-134 to E-154; A-134 to S-153; A-134 to D-152; A-134 to A-151; A-134 to I-150; A-134 to L-149; A-134 to Q-148; A-134 to L-147; A-134 to C-146; A-134 to D-145; A-134 to Q-144; A-134 to T-143; A-134 to V-142; A-134 to T-141; and A-134 to E-140 of SEQ ID NO:3228. The present invention is also directed to antibodies that bind B Lymphocyte Stimulator polypeptides comprising, or alternatively, consisting of, a contiguous sequence of amino acid residues at least 80%, 85%, 90%, 92%, 95%, 96%, 97%, 98% or 99% identical to the amino acid sequence of B Lymphocyte Stimulator polypeptides described above.

In additional embodiments, antibodies of the present invention may bind polypeptide fragments comprising, or alternatively consisting of, an amino acid sequence selected from the group consisting of residues: M-1 to C-15; D-2 to L-16; D-3 to K-17; S-4 to K-18; T-5 to R-19; E-6 to E-20; R-7 to E-21; E-8 to M-22; Q-9 to K-23; S-10 to L-24; R-11 to K-25; L-12 to E-26; T-13 to C-27; S-14 to V-28; C-15 to S-29; L-16 to I-30; K-17 to L-31; K-18 to P-32; R-19 to R-33; E-20 to K-34; E-21 to E-35; M-22 to S-36; K-23 to P-37; L-24 to S-38; K-25 to V-39; E-26 to R-40; C-27 to S-41; V-28 to S-42; S-29 to K-43; I-30 to D-44; L-31 to G-45; P-32 to K-46; R-33 to L-47; K-34 to L-48; E-35 to A-49; S-36 to A-50; P-37 to T-51; S-38 to L-52; V-39 to L-53; R-40 to L-54; S-41 to A-55; S-42 to L-56; K-43 to L-57; D-44 to S-58; G-45 to C-59; K-46 to C-60; L-47 to L-61; L-48 to T-62; A-49 to V-63; A-50 to V-64; T-51 to S-65; L-52 to F-66; L-53 to Y-67; L-54 to Q-68; A-55 to V-69; L-56 to A-70; L-57 to A-71; S-58 to L-72; C-59 to Q-73; C-60 to G-74; L-61 to D-75; T-62 to L-76; V-63 to A-77; V-64 to S-78; S-65 to L-79; F-66 to R-80; Y-67 to A-81; Q-68 to E-82; V-69 to L-83; A-70 to Q-84; A-71 to G-85; L-72 to H-86; Q-73 to H-87; G-74 to A-88; D-75 to E-89; L-76 to K-90; A-77 to L-91; S-78 to P-92; L-79 to A-93; R-80 to G-94; A-81 to A-95; E-82 to G-96; L-83 to A-97; Q-84 to P-98; G-85 to K-99; H-86 to A-100; H-87 to G-101; A-88 to L-102; E-89 to E-103; K-90 to E-104; L-91 to A-105; P-92 to P-106; A-93 to A-107; G-94 to V-108; A-95 to T-109; G-96 to A-110; A-97 to G-111; P-98 to L-112; K-99 to K-113; A-100 to I-114; G-101 to F-115; L-102 to E-116; E-103 to P-117; E-104 to P-118; A-105 to A-119; P-106 to P-120; A-107 to G-121; V-108 to E-122; T-109 to G-123; A-110 to N-124; G-111 to S-125; L-112 to S-126; K-113 to Q-127; I-114 to N-128; F-115 to S-129; E-116 to R-130; P-117 to N-131; P-118 to K-132; A-119 to R-133; P-120 to A-134; G-121 to V-135; E-122 to Q-136; G-123 to G-137; N-124 to P-138; S-125 to E-139; S-126 to E-140; Q-127 to T-141; N-128 to V-142; S-129 to T-143; R-130 to Q-144; N-131 to D-145; K-132 to C-146; R-133 to L-147; A-134 to Q-148; V-135 to L-149; Q-136 to I-150; G-137 to A-151; P-138 to D-152; E-139 to S-153; E-140 to E-154; T-141 to T-155; V-142 to P-156; T-143 to T-157; Q-144 to I-158; D-145 to Q-159; C-146 to K-160; L-147 to G-161; Q-148 to S-162; L-149 to Y-163; I-150 to T-164; A-151 to F-165; D-152 to V-166; S-153 to P-167; E-154 to W-168; T-155 to L-169; P-156 to L-170; T-157 to S-171; I-158 to F-172; Q-159 to K-173; K-160 to R-174; G-161 to G-175; S-162 to S-176; Y-163 to A-177; T-164 to L-178; F-165 to E-179; V-166 to E-180; P-167 to K-181; W-168 to E-182; L-169 to N-183; L-170 to K-184; S-171 to I-185; F-172 to L-186; K-173 to V-187; R-174 to K-188; G-175 to E-189; S-176 to T-190; A-177 to G-191; L-178 to Y-192; E-179 to F-193; E-180 to F-194; K-181 to I-195; E-182 to Y-196; N-183 to G-197; K-184 to Q-198; I-185 to V-199; L-186 to L-200; V-187 to Y-201; K-188 to T-202; E-189 to D-203; T-190 to K-204; G-191 to T-205; Y-192 to Y-206; F-193 to A-207; F-194 to M-208; I-195 to G-209; Y-196 to H-210; G-197 to L-211; Q-198 to I-212; V-199 to Q-213; L-200 to R-214; Y-201 to K-215; T-202 to K-216; D-203 to V-217; K-204 to H-218; T-205 to V-219; Y-206 to F-220; A-207 to G-221; M-208 to D-222; G-209 to E-223; H-210 to L-224; L-211 to S-225; I-212 to L-226; Q-213 to V-227; R-214 to T-228; K-215 to L-229; K-216 to F-230; V-217 to R-231; H-218 to C-232; V-219 to I-233; F-220 to Q-234; G-221 to N-235; D-222 to M-236; E-223 to P-237; L-224 to E-238; S-225 to T-239; L-226 to L-240; V-227 to P-241; T-228 to N-242; L-229 to N-243; F-230 to S-244; R-231 to C-245; C-232 to Y-246; I-233 to S-247; Q-234 to A-248; N-235 to G-249; M-236 to I-250; P-237 to A-251; E-238 to K-252; T-239 to L-253; L-240 to E-254; P-241 to E-255; N-242 to G-256; N-243 to D-257; S-244 to E-258; C-245 to L-259; Y-246 to Q-260; S-247 to L-261; A-248 to A-262; G-249 to I-263; I-250 to P-264; A-251 to R-265; K-252 to E-266; L-253 to N-267; E-254 to A-268; E-255 to Q-269; G-256 to I-270; D-257 to S-271; E-258 to L-272; L-259 to D-273; Q-260 to G-274; L-261 to D-275; A-262 to V-276; I-263 to T-277; P-264 to F-278; R-265 to F-279; E-266 to G-280; N-267 to A-281; A-268 to L-282; Q-269 to K-283; I-270 to L-284; and S-271 to L-285 of SEQ ID NO:3228. The present invention is also directed to antibodies that bind B Lymphocyte Stimulator polypeptides comprising, or alternatively, consisting of, a contiguous sequence of amino acid residues at least 80%, 85%, 90%, 92%, 95%, 96%, 97%, 98% or 99% identical to the amino acid sequence of B Lymphocyte Stimulator polypeptides described above.

In additional embodiments, antibodies of the present invention may bind polypeptide fragments comprising, or alternatively consisting of, an amino acid sequence selected from the group consisting of residues: M-1 to C-15; D-2 to L-16; D-3 to K-17; S-4 to K-18; T-5 to R-19; E-6 to E-20; R-7 to E-21; E-8 to M-22; Q-9 to K-23; S-10 to L-24; R-11 to K-25; L-12 to E-26; T-13 to C-27; S-14 to V-28; C-15 to S-29; L-16 to I-30; K-17 to L-31; K-18 to P-32; R-19 to R-33; E-20 to K-34; E-21 to E-35; M-22 to S-36; K-23 to P-37; L-24 to S-38; K-25 to V-39; E-26 to R-40; C-27 to S-41; V-28 to S-42; S-29 to K-43; I-30 to D-44; L-31 to G-45; P-32 to K-46; R-33 to L-47; K-34 to L-48; E-35 to A-49; S-36 to A-50; P-37 to T-51; S-38 to L-52; V-39 to L-53; R-40 to L-54; S-41 to A-55; S-42 to L-56; K-43 to L-57; D-44 to S-58; G-45 to C-59; K-46 to C-60; L-47 to L-61; L-48 to T-62; A-49 to V-63; A-50 to V-64; T-51 to S-65; L-52 to F-66; L-53 to Y-67; L-54 to Q-68; A-55 to V-69; L-56 to A-70; L-57 to A-71; S-58 to L-72; C-59 to Q-73; C-60 to G-74; L-61 to D-75; T-62 to L-76; V-63 to A-77; V-64 to S-78; S-65 to L-79; F-66 to R-80; Y-67 to A-81; Q-68 to E-82; V-69 to L-83; A-70 to Q-84; A-71 to G-85; L-72 to H-86; Q-73 to H-87; G-74 to A-88; D-75 to E-89; L-76 to K-90; A-77 to L-91; S-78 to P-92; L-79 to A-93; R-80 to G-94; A-81 to A-95; E-82 to G-96; L-83 to A-97; Q-84 to P-98; G-85 to K-99; H-86 to A-100; H-87 to G-101; A-88 to L-102; E-89 to E-103; K-90 to E-104; L-91 to A-105; P-92 to P-106; A-93 to A-107; G-94 to V-108; A-95 to T-109; G-96 to A-110; A-97 to G-111; P-98 to L-112; K-99 to K-113; A-100 to I-114; G-101 to F-115; L-102 to E-116; E-103 to P-117; E-104 to P-118; A-105 to A-119; P-106 to P-120; A-107 to G-121; V-108 to E-122; T-109 to G-123; A-110 to N-124; G-111 to S-125; L-112 to S-126; K-113 to Q-127; I114 to N-128; F-115 to S-129; E-116 to R-130; P-117 to N-131; P-118 to K-132; A-119 to R-133; P-120 to A-134; G-121 to V-135; E-122 to Q-136; G-123 to G-137; N-124 to P-138; S-125 to E-139; S-126 to E-140; Q-127 to T-141; N-128 to G-142; S-129 to S-143; R-130 to Y-144; N-131 to T-145; K-132 to F-146; R-133 to V-147; A-134 to P-148; V-135 to W-149; Q-136 to L-150; G-137 to L-151; P-138 to S-152; E-139 to F-153; E-140 to K-154; T-141 to R-155; G-142 to G-156; S-143 to S-157; Y-144 to A-158; T-145 to L-159; F-146 to E-160; V-147 to E-161; P-148 to K-162; W-149 to E-163; L-150 to N-164; L-151 to K-165; S-152 to I-166; F-153 to L-167; K-154 to V-168; R-155 to K-169; G-156 to E-170; S-157 to T-171; A-158 to G-172; L-159 to Y-173; E-160 to F-174; E-161 to F-175; K-162 to I-176; E-163 to Y-177; N-164 to G-178; K-165 to Q-179; I-166 to V-180; L-167 to L-181; V-168 to Y-182; K-169 to T-183; E-170 to D-184; T-171 to K-185; G-172 to T-186; Y-173 to Y-187; F-174 to A-188; F-175 to M-189; I-176 to G-190; Y-177 to H-191; G-178 to L-192; Q-179 to I-193; V-180 to Q-194; L-181 to R-195; Y-182 to K-196; T-183 to K-197; D-184 to V-198; K-185 to H-199; T-186 to V-200; Y-187 to F-201; A-188 to G-202; M-189 to D-203; G-190 to E-204; H-191 to L-205; L-192 to S-206; I-193 to L-207; Q-194 to V-208; R-195 to T-209; K-196 to L-210; K-197 to F-211; V-198 to R-212; H-199 to C-213; V-200 to I-214; F-201 to Q-215; G-202 to N-216; D-203 to M-217; E-204 to P-218; L-205 to E-219; S-206 to T-220; L-207 to L-221; V-208 to P-222; T-209 to N-223; L-210 to N-224; F-211 to S-225; R-212 to C-226; C-213 to Y-227; I-214 to S-228; Q-215 to A-229; N-216 to G-230; M-217 to I-231; P-218 to A-232; E-219 to K-233; T-220 to L-234; L-221 to E-235; P-222 to E-236; N-223 to G-237; N-224 to D-238; S-225 to E-239; C-226 to L-240; Y-227 to Q-241; S-228 to L-242; A-229 to A-243; G-230 to I-244; I-231 to P-245; A-232 to R-246; K-233 to E-247; L-234 to N-248; E-235 to A-249; E-236 to Q-250; G-237 to I-251; D-238 to S-252; E-239 to L-253; L-240 to D-254; Q-241 to G-255; L-242 to D-256; A-243 to V-257; I-244 to T-258; P-245 to F-259; R-246 to F-260; E-247 to G-261; N-248 to A-262; A-249 to L-263; Q-250 to K-264; I-251 to L-265; and S-252 to L-266 of SEQ ID NO:3229. The present invention is also directed to antibodies that bind B Lymphocyte Stimulator polypeptides comprising, or alternatively, consisting of, a contiguous sequence of amino acid residues at least 80%, 85%, 90%, 92%, 95%, 96%, 97%, 98% or 99% identical to the amino acid sequence of B Lymphocyte Stimulator polypeptides described above.

In additional embodiments, antibodies of the present invention may bind polypeptide fragments comprising, or alternatively consisting of, an amino acid sequence selected from the group consisting of residues: M-1 to F-15; D-2 to C-16; E-3 to S-17; S-4 to E-18; A-5 to K-19; K-6 to G-20; T-7 to E-21; L-8 to D-22; P-9 to M-23; P-10 to K-24; P-11 to V-25; C-12 to G-26; L-13 to Y-27; C-14 to D-28; F-15 to P-29; C-16 to I-30; S-17 to T-31; E-18 to P-32; K-19 to Q-33; G-20 to K-34; E-21 to E-35; D-22 to E-36; M-23 to G-37; K-24 to A-38; V-25 to W-39; G-26 to F-40; Y-27 to G-41; D-28 to I-42; P-29 to C-43; I-30 to R-44; T-31 to D-45; P-32 to G-46; Q-33 to R-47; K-34 to L-48; E-35 to L-49; E-36 to A-50; G-37 to A-51; A-38 to T-52; W-39 to L-53; F-40 to L-54; G-41 to L-55; I-42 to A-56; C-43 to L-57; R-44 to L-58; D-45 to S-59; G-46 to S-60; R-47 to S-61; L-48 to F-62; L-49 to T-63; A-50 to A-64; A-51 to M-65; T-52 to S-66; L-53 to L-67; L-54 to Y-68; L-55 to Q-69; A-56 to L-70; L-57 to A-71; L-58 to A-72; S-59 to L-73; S-60 to Q-74; S-61 to A-75; F-62 to D-76; T-63 to L-77; A-64 to M-78; M-65 to N-79; S-66 to L-80; L-67 to R-81; Y-68 to M-82; Q-69 to E-83; L-70 to L-84; A-71 to Q-85; A-72 to S-86; L-73 to Y-87; Q-74 to R-88; A-75 to G-89; D-76 to S-90; L-77 to A-91; M-78 to T-92; N-79 to P-93; L-80 to A-94; R-81 to A-95; M-82 to A-96; E-83 to G-97; L-84 to A-98; Q-85 to P-99; S-86 to E-100; Y-87 to L-101; R-88 to T-102; G-89 to A-103; S-90 to G-104; A-91 to V-105; T-92 to K-106; P-93 to L-107; A-94 to L-108; A-95 to T-109; A-96 to P-110; G-97 to A-111; A-98 to A-112; P-99 to P-113; E-100 to R-114; L-101 to P-115; T-102 to H-116; A-103 to N-117; G-104 to S-118; V-105 to S-119; K-106 to R-120; L-107 to G-121; L-108 to H-122; T-109 to R-123; P-110 to N-124; A-111 to R-125; A-112 to R-126; P-113 to A-127; R-114 to F-128; P-115 to Q-129;

H-116 to G-130; N-117 to P-131; S-118 to E-132; S-119 to E-133; R-120 to T-134; G-121 to E-135; H-122 to Q-136; R-123 to D-137; N-124 to V-138; R-125 to D-139; R-126 to L-140; A-127 to S-141; F-128 to A-142; Q-129 to P-143; G-130 to P-144; P-131 to A-145; E-132 to P-146; E-133 to C-147; T-134 to L-148; E-135 to P-149; Q-136 to G-150; D-137 to C-151; V-138 to R-152; D-139 to H-153; L-140 to S-154; S-141 to Q-155; A-142 to H-156; P-143 to D-157; P-144 to D-158; A-145 to N-159; P-146 to G-160; C-147 to M-161; L-148 to N-162; P-149 to L-163; G-150 to R-164; C-151 to N-165; R-152 to I-166; H-153 to I-167; S-154 to Q-168; Q-155 to D-169; H-156 to C-170; D-157 to L-171; D-158 to Q-172; N-159 to L-173; G-160 to I-174; M-161 to A-175; N-162 to D-176; L-163 to S-177; R-164 to D-178; N-165 to T-179; I-166 to P-180; I-167 to A-181; Q-168 to L-182; D-169 to E-183; C-170 to E-184; L-171 to K-185; Q-172 to E-186; L-173 to N-187; I-174 to K-188; A-175 to I-189; D-176 to V-190; S-177 to V-191; D-178 to R-192; T-179 to Q-193; P-180 to T-194; A-181 to G-195; L-182 to Y-196; E-183 to F-197; E-184 to F-198; K-185 to I-199; E-186 to Y-200; N-187 to S-201; K-188 to Q-202; I-189 to V-203; V-190 to L-204; V-191 to Y-205; R-192 to T-206; Q-193 to D-207; T-194 to P-208; G-195 to I-209; Y-196 to F-210; F-197 to A-211; F-198 to M-212; I-199 to G-213; Y-200 to H-214; S-201 to V-215; Q-202 to I-216; V-203 to Q-217; L-204 to R-218; Y-205 to K-219; T-206 to K-220; D-207 to V-221; P-208 to H-222; I-209 to V-223; F-210 to F-224; A-211 to G-225; M-212 to D-226; G-213 to E-227; H-214 to L-228; V-215 to S-229; I-216 to L-230; Q-217 to V-231; R-218 to T-232; K-219 to L-233; K-220 to F-234; V-221 to R-235; H-222 to C-236; V-223 to I-237; F-224 to Q-238; G-225 to N-239; D-226 to M-240; E-227 to P-241; L-228 to K-242; S-229 to T-243; L-230 to L-244; V-231 to P-245; T-232 to N-246; L-233 to N-247; F-234 to S-248; R-235 to C-249; C-236 to Y-250; I-237 to S-251; Q-238 to A-252; N-239 to G-253; M-240 to I-254; P-241 to A-255; K-242 to R-256; T-243 to L-257; L-244 to E-258; P-245 to E-259; N-246 to G-260; N-247 to D-261; S-248 to E-262; C-249 to I-263; Y-250 to Q-264; S-251 to L-265; A-252 to A-266; G-253 to I-267; I-254 to P-268; A-255 to R-269; R-256 to E-270; L-257 to N-271; E-258 to A-272; E-259 to Q-273; G-260 to I-274; D-261 to S-275; E-262 to R-276; I-263 to N-277; Q-264 to G-278; L-265 to D-279; A-266 to D-280; I-267 to T-281; P-268 to F-282; R-269 to F-283; E-270 to G-284; N-271 to A-285; A-272 to L-286; Q-273 to K-287; I-274 to L-288; and S-275 to L-289 of SEQ ID NO:38. The present invention is also directed to antibodies that bind B Lymphocyte Stimulator polypeptides comprising, or alternatively, consisting of, a contiguous sequence of amino acid residues at least 80%, 85%, 90%, 92%, 95%, 96%, 97%, 98% or 99% identical to the amino acid sequence of B Lymphocyte Stimulator polypeptides described above.

It will be recognized by one of ordinary skill in the art that some amino acid sequences of the B Lymphocyte Stimulator polypeptides can be varied without significant effect of the structure or function of the polypeptide. If such differences in sequence are contemplated, it should be remembered that there will be critical areas on the polypeptide which determine activity.

Thus, the invention further includes antibodies that bind variations of B Lymphocyte Stimulator polypeptides which show B Lymphocyte Stimulator polypeptide functional activity (e.g., biological activity) or which include regions of B Lymphocyte Stimulator polypeptide such as the polypeptide fragments described herein. Such mutants include deletions, insertions, inversions, repeats, and type substitutions selected according to general rules known in the art so as have little effect on activity. For example, guidance concerning how to make phenotypically silent amino acid substitutions is provided in Bowie, J. U. et al., "Deciphering the Message in Protein Sequences: Tolerance to Amino Acid Substitutions," *Science* 247:1306–1310 (1990), wherein the authors indicate that there are two main approaches for studying the tolerance of an amino acid sequence to change. The first method relies on the process of evolution, in which mutations are either accepted or rejected by natural selection. The second approach uses genetic engineering to introduce amino acid changes at specific positions of a cloned gene and selections or screens to identify sequences that maintain functionality.

As the authors state, these studies have revealed that proteins are surprisingly tolerant of amino acid substitutions. The authors further indicate which amino acid changes are likely to be permissive at a certain position of the protein. For example, most buried amino acid residues require nonpolar side chains, whereas few features of surface side chains are generally conserved. Other such phenotypically silent substitutions are described in Bowie, J. U. et al., supra, and the references cited therein. Typically seen as conservative substitutions are the replacements, one for another, among the aliphatic amino acids Ala, Val, Leu and Ile; interchange of the hydroxyl residues Ser and Thr, exchange of the acidic residues Asp and Glu, substitution between the amide residues Asn and Gln, exchange of the basic residues Lys and Arg and replacements among the aromatic residues Phe, Tyr.

Thus, antibodies of the present invention may bind fragments, derivatives or analogs of the polypeptide of SEQ ID NO:3228, or that encoded by the deposited cDNA plasmid, such as (i) polypeptides in which one or more of the amino acid residues are substituted with a conserved or non-conserved amino acid residue (preferably a conserved amino acid residue) and such substituted amino acid residue may or may not be one encoded by the genetic code, or (ii) polypeptides in which one or more of the amino acid residues includes a substituent group, or (iii) polypeptides in which the extracellular domain of the polypeptide is fused with another compound, such as a compound to increase the half-life of the polypeptide (for example, polyethylene glycol), or (iv) polypeptides in which the additional amino acids are fused to the extracellular domain of the polypeptide, such as an IgG Fc fusion region peptide or leader or secretory sequence or a sequence which is employed for purification of the extracellular domain of the polypeptide or a proprotein sequence.

Antibodies of the present invention may bind fragments, derivatives or analogs of the polypeptide of SEQ ID NO:3229, or that encoded by the deposited cDNA plasmid, such as (i) polypeptides in which one or more of the amino acid residues are substituted with a conserved or non-conserved amino acid residue (preferably a conserved amino acid residue) and such substituted amino acid residue may or may not be one encoded by the genetic code, or (ii) polypeptides in which one or more of the amino acid residues includes a substituent group, or (iii) polypeptides in which the extracellular domain of the polypeptide is fused with another compound, such as a compound to increase the half-life of the polypeptide (for example, polyethylene glycol), or (iv) polypeptides in which the additional amino acids are fused to the extracellular domain of the polypeptide, such as, a soluble biologically active fragment of another TNF ligand family member (e.g., CD40 Ligand), an IgG Fc fusion region peptide or leader or secretory sequence or a sequence which is employed for purification of the extracellular domain of the polypeptide or a proprotein sequence. Such fragments, derivatives and analogs are deemed to be within the scope of those skilled in the art from the teachings herein.

Thus, the antibodies of the invention may bind B Lymphocyte Stimulator polypeptides that include one or more amino acid substitutions, deletions or additions, either from natural mutations or human manipulation. As indicated, changes are preferably of a minor nature, such as conservative amino acid substitutions that do not significantly affect the folding or activity of the protein (see Table 13).

TABLE 13

| Conservative Amino Acid Substitutions. | |
|---|---|
| Aromatic | Phenylalanine |
| | Tryptophan |
| | Tyrosine |
| Hydrophobic | Leucine |
| | Isoleucine |
| | Valine |
| Polar | Glutamine |
| | Asparagine |
| Basic | Arginine |
| | Lysine |
| | Histidine |
| Acidic | Aspartic Acid |
| | Glutamic Acid |
| Small | Alanine |
| | Serine |
| | Threonine |
| | Methionine |
| | Glycine |

In one embodiment of the invention, antibodies of the present invention bind polypeptides comprising, or alternatively consisting of, the amino acid sequence of a B Lymphocyte Stimulator polypeptide having an amino acid sequence which contains at least one conservative amino acid substitution, but not more than 50 conservative amino acid substitutions, even more preferably, not more than 40 conservative amino acid substitutions, still more preferably, not more than 30 conservative amino acid substitutions, and still even more preferably, not more than 20 conservative amino acid substitutions. In one embodiment of the invention, antibodies of the present invention bind polypeptides comprising, or alternatively consisting of, the amino acid sequence of a B Lymphocyte Stimulator polypeptide having an amino acid sequence which contains at least one conservative amino acid substitution, but not more than 10, 9, 8, 7, 6, 5, 4, 3, 2 or 1 conservative amino acid substitutions.

For example, site directed changes at the amino acid level of B Lymphocyte Stimulator can be made by replacing a particular amino acid with a conservative substitution. Antibodies of the present invention may bind B Lymphocyte Stimulator amino acid sequences containing conservative substitution mutations of the polypeptide of SEQ ID NO:3228 including: M1 replaced with A, G, I, L, S, T, or V; D2 replaced with E; D3 replaced with E; S4 replaced with A, G, I, L, T, M, or V; T5 replaced with A, G, I, L, S, M, or V; E6 replaced with D; R7 replaced with H, or K; E8 replaced with D; Q9 replaced with N; S10 replaced with A, G, I, L, T, M, or V; R11 replaced with H, or K; L12 replaced with A, G, I, S, T, M, or V; T13 replaced with A, G, I, L, S, M, or V; S14 replaced with A, G, I, L, T, M, or V; L16 replaced with A, G, I, S, T, M, or V; K17 replaced with H, or R; K18 replaced with H, or R; R19 replaced with H, or K; E20 replaced with D; E21 replaced with D; M22 replaced with A, G, I, L, S, T, or V; K23 replaced with H, or R; L24 replaced with A, G, I, S, T, M, or V; K25 replaced with H, or R; E26 replaced with D; V28 replaced with A, G, I, L, S, T, or M; S29 replaced with A, G, I, L, T, M, or V; I30 replaced with A, G, L, S, T, M, or V; L31 replaced with A, G, I, S, T, M, or V; R33 replaced with H, or K; K34 replaced with H, or R; E35 replaced with D; S36 replaced with A, G, I, L, T, M, or V; S38 replaced with A, G, I, L, T, M, or V; V39 replaced with A, G, I, L, S, T, or M; R40 replaced with H, or K; S41 replaced with A, G, I, L, T, M, or V; S42 replaced with A, G, I, L, T, M, or V; K43 replaced with H, or R; D44 replaced with E; G45 replaced with A, I, L, S, T, M, or V; K46 replaced with H, or R; L47 replaced with A, G, I, S, T, M, or V; L48 replaced with A, G, I, S, T, M, or V; A49 replaced with G, I, L, S, T, M, or V; A50 replaced with G, I, L, S, T, M, or V; T51 replaced with A, G, I, L, S, M, or V; L52 replaced with A, G, I, S, T, M, or V; L53 replaced with A, G, I, S, T, M, or V; L54 replaced with A, G, I, S, T, M, or V; A55 replaced with G, I, L, S, T, M, or V; L56 replaced with A, G, I, S, T, M, or V; L57 replaced with A, G, I, S, T, M, or V; S58 replaced with A, G, I, L, T, M, or V; L61 replaced with A, G, I, S, T, M, or V; T62 replaced with A, G, I, L, S, M, or V; V63 replaced with A, G, I, L, S, T, or M; V64 replaced with A, G, I, L, S, T, or M; S65 replaced with A, G, I, L, T, M, or V; F66 replaced with W, or Y; Y67 replaced with F, or W; Q68 replaced with N; V69 replaced with A, G, I, L, S, T, or M; A70 replaced with G, I, L, S, T, M, or V; A71 replaced with G, I, L, S, T, M, or V; L72 replaced with A, G, I, S, T, M, or V; Q73 replaced with N; G74 replaced with A, I, L, S, T, M, or V; D75 replaced with E; L76 replaced with A, G, I, S, T, M, or V; A77 replaced with G, I, L, S, T, M, or V; S78 replaced with A, G, I, L, T, M, or V; L79 replaced with A, G, I, S, T, M, or V; R80 replaced with H, or K; A81 replaced with G, I, L, S, T, M, or V; E82 replaced with D; L83 replaced with A, G, I, S, T, M, or V; Q84 replaced with N; G85 replaced with A, I, L, S, T, M, or V; H86 replaced with K, or R; H87 replaced with K, or R; A88 replaced with G, I, L, S, T, M, or V; E89 replaced with D; K90 replaced with H, or R; L91 replaced with A, G, I, S, T, M, or V; A93 replaced with G, I, L, S, T, M, or V; G94 replaced with A, I, L, S, T, M, or V; A95 replaced with G, I, L, S, T, M, or V; G96 replaced with A, I, L, S, T, M, or V; A97 replaced with G, I, L, S, T, M, or V; K99 replaced with H, or R; A100 replaced with G, I, L, S, T, M, or V; G101 replaced with A, I, L, S, T, M, or V; L102 replaced with A, G, I, S, T, M, or V; E103 replaced with D; E104 replaced with D; A105 replaced with G, I, L, S, T, M, or V; A107 replaced with G, I, L, S, T, M, or V; V108 replaced with A, G, I, L, S, T, or M; T109 replaced with A, G, I, L, S, M, or V; A110 replaced with G, I, L, S, T, M, or V; G111 replaced with A, I, L, S, T, M, or V; L112 replaced with A, G, I, S, T, M, or V; K113 replaced with H, or R; I114 replaced with A, G, L, S, T, M, or V; F115 replaced with W, or Y; E116 replaced with D; A119 replaced with G, I, L, S, T, M, or V; G121 replaced with A, I, L, S, T, M, or V; E122 replaced with D; G123 replaced with A, I, L, S, T, M, or V; N124 replaced with Q; S125 replaced with A, G, I, L, T, M, or V; S126 replaced with A, G, I, L, T, M, or V; Q127 replaced with N; N128 replaced with Q; S129 replaced with A, G, I, L, T, M, or V; R130 replaced with H, or K; N131 replaced with Q; K132 replaced with H, or R; R133 replaced with H, or K; A134 replaced with G, I, L, S, T, M, or V; V135 replaced with A, G, I, L, S, T, or M; Q136 replaced with N; G137 replaced with A, I, L, S, T, M, or V; E139 replaced with D; E140 replaced with D; T141 replaced with A, G, I, L, S, M, or V; V142 replaced with A, G, I, L, S, T, or M; T143 replaced with A, G, I, L, S, M, or V; Q144 replaced with N; D145 replaced with E; L147 replaced with A, G, I, S, T, M, or V; Q148 replaced with N; L149 replaced with A, G, I, S, T, M, or V; I150 replaced with A, G, L, S, T, M, or V; A151 replaced with G, I, L, S, T, M, or V; D152 replaced with E; S153 replaced with A, G, I, L, T, M, or V; E154 replaced with D; T155 replaced with A, G, I, L, S, M, or V; T157 replaced with A, G, I, L, S, M, or V; I158 replaced with A, G, L, S, T, M, or V; Q159 replaced with N; K160 replaced with H, or R; G161 replaced with A, I, L, S, T, M, or V; S162 replaced with A, G, I, L, T, M, or V; Y163 replaced with F, or W; T164 replaced with A, G, I, L, S, M, or V; F165 replaced with W, or Y; V166 replaced with A, G, I, L, S, T, or M; W168 replaced with F, or Y; L169 replaced with A, G, I, S, T, M, or V; L170 replaced with A, G, I, S, T, M, or V; S171 replaced with A, G, I, L, T, M, or V; F172 replaced with W, or Y; K173 replaced with H, or R; R174 replaced with H, or K; G175 replaced with A, I, L, S, T, M, or V; S176 replaced with A, G, I, L, T, M, or V; A177 replaced with G, I, L, S, T, M, or V; L178 replaced with A, G, I, S, T, M, or V; E179 replaced with D; E180 replaced with D; K181 replaced with H, or R; E182 replaced with D; N183 replaced with Q; K184 replaced with H, or R; I185 replaced with A, G, L, S, T, M, or V; L186 replaced with A, G, I, S, T, M, or V; V187 replaced with A, G, I, L, S, T, or M; K188 replaced with H, or R; E189 replaced with D; T190 replaced with A, G, I, L, S, M, or V; G191 replaced with A, I, L, S, T, M, or V; Y192 replaced with F, or W; F193 replaced with W, or Y; F194 replaced with W, or Y; I195 replaced with A, G, L, S, T, M, or V; Y196 replaced with F, or W; G197 replaced with A, I, L, S, T, M, or V; Q198 replaced with N; V199 replaced with A, G, I, L, S, T, or M; L200 replaced with A, G, I, S, T, M, or V; Y201 replaced with F, or W; T202 replaced with A, G, I, L, S, M, or V; D203 replaced with E; K204 replaced with H, or R; T205 replaced with A, G, I, L, S, M, or V; Y206 replaced with F, or W; A207 replaced with G, I, L, S, T, M, or V; M208 replaced with A, G, I, L, S, T, or V; G209 replaced with A, I, L, S, T, M, or V; H210 replaced with K, or R; L211 replaced with A, G, I, S, T, M, or V; I212 replaced with A, G, L, S, T, M, or V; Q213 replaced with N; R214 replaced with H, or K; K215 replaced with H, or R; K216 replaced with H, or R; V217 replaced with A, G, I, L, S, T, or M; H218 replaced with K, or R; V219 replaced with A, G, I, L, S, T, or M; F220 replaced with W, or Y; G221 replaced with A, I, L, S, T, M, or V; D222 replaced with E; E223 replaced with D; L224 replaced with A, G, I, S, T, M, or V; S225 replaced with A, G, I, L, T, M, or V; L226 replaced with A, G, I, S, T, M, or V; V227 replaced with A, G, I, L, S, T, or M; T228 replaced with A, G, I, L, S, M, or V; L229 replaced with A, G, I, S, T, M, or V; F230 replaced with W, or Y; R231 replaced with H, or K; I233 replaced with A, G, L, S, T, M, or V; Q234 replaced with N; N235 replaced with Q; M236 replaced with A, G, I, L, S, T, or V; E238 replaced with D; T239 replaced with A, G, I, L, S, M, or V; L240 replaced with A, G, I, S, T, M, or V; N242 replaced with Q; N243 replaced with Q; S244 replaced with A, G, I, L, T, M, or V; Y246 replaced with F, or W; S247 replaced with A, G, I, L, T, M, or V; A248 replaced with G, I, L, S, T, M, or V; G249 replaced with A, I, L, S, T, M, or V; I250 replaced with A, G, L, S, T, M, or V; A251 replaced with G, I, L, S, T, M, or V; K252 replaced with H, or R; L253 replaced with A, G, I, S, T, M, or V; E254 replaced with D; E255 replaced with D; G256 replaced with A, I, L, S, T, M, or V; D257 replaced with E; E258 replaced with D; L259 replaced with A, G, I, S, T, M, or V; Q260 replaced with N; L261 replaced with A, G, I, S, T, M, or V; A262 replaced with G, I, L, S, T, M, or V; I263 replaced with A, G, L, S, T, M, or V; R265 replaced with H, or K; E266 replaced with D; N267 replaced with Q; A268 replaced with G, I, L, S, T, M, or V; Q269 replaced with N; I270 replaced with A, G, L, S, T, M, or V; S271 replaced with A, G, I, L, T, M, or V; L272 replaced with A, G, I, S, T, M, or V; D273 replaced with E; G274 replaced with A, I, L, S, T, M, or V; D275 replaced with E; V276 replaced with A, G, I, L, S, T, or M; T277 replaced with A, G, I, L, S, M, or V; F278 replaced with W, or Y; F279 replaced with W, or Y; G280 replaced with A, I, L, S, T, M, or V; A281 replaced with G, I, L, S, T, M, or V; L282 replaced with A, G, I, S, T, M, or V; K283 replaced with H, or R; L284 replaced with A, G, I, S, T, M, or V; and/or L285 replaced with A, G, I, S, T, M, or V.

In another embodiment, site directed changes at the amino acid level of B Lymphocyte Stimulator can be made by replacing a particular amino acid with a conservative substitution. Antibodies of the present invention may bind B Lymphocyte Stimulator amino acid sequences containing conservative substitution mutations of the polypeptide of SEQ ID NO:3229 including: M1 replaced with A, G, I, L, S, T, or V; D2 replaced with E; D3 replaced with E; S4 replaced with A, G, I, L, T, M, or V; T5 replaced with A, G, I, L, S, M, or V; E6 replaced with D; R7 replaced with H, or K; E8 replaced with D; Q9 replaced with N; S10 replaced with A, G, I, L, T, M, or V; R11 replaced with H, or K; L12 replaced with A, G, I, S, T, M, or V; T13 replaced with A, G, I, L, S, M, or V; S14 replaced with A, G, I, L, T, M, or V; L16 replaced with A, G, I, S, T, M, or V; K17 replaced with H, or R; K18 replaced with H, or R; R19 replaced with H, or K; E20 replaced with D; E21 replaced with D; M22 replaced with A, G, I, L, S, T, or V; K23 replaced with H, or R; L24 replaced with A, G, I, S, T, M, or V; K25 replaced with H, or R; E26 replaced with D; V28 replaced with A, G, I, L, S, T, or M; S29 replaced with A, G, I, L, T, M, or V; I30 replaced with A, G, L, S, T, M, or V; L31 replaced with A, G, I, S, T, M, or V; R33 replaced with H, or K; K34 replaced with H, or R; E35 replaced with D; S36 replaced with A, G, I, L, T, M, or V; S38 replaced with A, G, I, L, T, M, or V; V39 replaced with A, G, I, L, S, T, or M; R40 replaced with H, or K; S41 replaced with A, G, I, L, T, M, or V; S42 replaced with A, G, I, L, T, M, or V; K43 replaced with H, or R; D44 replaced with E; G45 replaced with A, I, L, S, T, M, or V; K46 replaced with H, or R; L47 replaced with A, G, I, S, T, M, or V; L48 replaced with A, G, I, S, T, M, or V; A49 replaced with G, I, L, S, T, M, or V; A50 replaced with G, I, L, S, T, M, or V; T51 replaced with A, G, I, L, S, M, or V; L52 replaced with A, G, I, S, T, M, or V; L53 replaced with A, G, I, S, T, M, or V; L54 replaced with A, G, I, S, T, M, or V; A55 replaced with G, I, L, S, T, M, or V; L56 replaced with A, G, I, S, T, M, or V; L57 replaced with A, G, I, S, T, M, or V; S58 replaced with A, G, I, L, T, M, or V; L61 replaced with A, G, I, S, T, M, or V; T62 replaced with A, G, I, L, S, M, or V; V63 replaced with A, G, I, L, S, T, or M; V64 replaced with A, G, I, L, S, T, or M; S65 replaced with A, G, I, L, T, M, or V; F66 replaced with W, or Y; Y67 replaced with F, or W; Q68 replaced with N; V69 replaced with A, G, I, L, S, T, or M; A70 replaced with G, I, L, S, T, M, or V; A71 replaced with G, I, L, S, T, M, or V; L72 replaced with A, G, I, S, T, M, or V; Q73 replaced with N; G74 replaced with A, I, L, S, T, M, or V; D75 replaced with E; L76 replaced with A, G, I, S, T, M, or V; A77 replaced with G, I, L, S, T, M, or V; S78 replaced with A, G, I, L, T, M, or V; L79 replaced with A, G, I, S, T, M, or V; R80 replaced with H, or K; A81 replaced with G, I, L, S, T, M, or V; E82 replaced with D; L83 replaced with A, G, I, S, T, M, or V; Q84 replaced with N; G85 replaced with A, I, L, S, T, M, or V; H86 replaced with K, or R; H87 replaced with K, or R; A88 replaced with G, I, L, S, T, M, or V; E89 replaced with D; K90 replaced with H, or R; L91 replaced with A, G, I, S, T, M, or V; A93 replaced with G, I, L, S, T, M, or V; G94 replaced with A, I, L, S, T, M, or V; A95 replaced with G, I, L, S, T, M, or V; G96 replaced with A, I, L, S, T, M, or V; A97 replaced with G, I, L, S, T, M, or V; K99 replaced with H, or R; A100 replaced with G, I, L, S, T, M, or V; G101 replaced with A, I, L, S, T, M, or V; L102 replaced with A, G, I, S, T, M, or V; E103 replaced with D; E104 replaced with D; A105 replaced with G, I, L, S, T, M, or V; A107 replaced with G, I, L, S, T, M, or V; V108 replaced with A, G, I, L, S, T, or M; T109 replaced with A, G, I, L, S, M, or V; A110 replaced with G, I, L, S, T, M, or V; G111 replaced with A, I, L, S, T, M, or V; L112 replaced with A, G, I, S, T, M, or V; K113 replaced with H, or R; I114 replaced with A, G, L, S, T, M, or V; F115 replaced with W, or Y; E116 replaced with D; A119 replaced with G, I, L, S, T, M, or V; G121 replaced with A, I, L, S, T, M, or V; E122 replaced with D; G123 replaced with A, I, L, S, T, M, or V; N124 replaced with Q; S125 replaced with A, G, I, L, T, M, or V; S126 replaced with A, G, I, L, T, M, or V; Q127 replaced with N; N128 replaced with Q; S129 replaced with A, G, I, L, T, M, or V; R130 replaced with H, or K; N131 replaced with Q; K132 replaced with H, or R; R133 replaced with H, or K; A134 replaced with G, I, L, S, T, M, or V; V135 replaced with A, G, I, L, S, T, or M; Q136 replaced with N; G137 replaced with A, I, L, S, T, M, or V; E139 replaced with D; E140 replaced with D; T141 replaced with A, G, I, L, S, M, or V; G142 replaced with A, I, L, S, T, M, or V; S143 replaced with A, G, I, L, T, M, or V; Y144 replaced with F, or W; T145 replaced with A, G, I, L, S, M, or V; F146 replaced with W, or Y; V147 replaced with A, G, I, L, S, T, or M; W149 replaced with F, or Y; L150 replaced with A, G, I, S, T, M, or V; L151 replaced with A, G, I, S, T, M, or V; S152 replaced with A, G, I, L, T, M, or V; F153 replaced with W, or Y; K154 replaced with H, or R; R155 replaced with H, or K; G156 replaced with A, I, L, S, T, M, or V; S157 replaced with A, G, I, L, T, M, or V; A158 replaced with G, I, L, S, T, M, or V; L159 replaced with A, G, I, S, T, M, or V; E160 replaced with D; E161 replaced with D; K162 replaced with H, or R; E163 replaced with D; N164 replaced with Q; K165 replaced with H, or R; I166 replaced with A, G, L, S, T, M, or V; L167 replaced with A, G, I, S, T, M, or V; V168 replaced with A, G, I, L, S, T, or M; K169 replaced with H, or R; E170 replaced with D; T171 replaced with A, G, I, L, S, M, or V; G172 replaced with A, I, L, S, T, M, or V; Y173 replaced with F, or W; F174 replaced with W, or Y; F175 replaced with W, or Y; I176 replaced with A, G, L, S, T, M, or V; Y177 replaced with F, or W; G178 replaced with A, I, L, S, T, M, or V; Q179 replaced with N; V180 replaced with A, G, I, L, S, T, or M; L181 replaced with A, G, I, S, T, M, or V; Y182 replaced with F, or W; T183 replaced with A, G, I, L, S, M, or V; D184 replaced with E; K185 replaced with H, or R; T186 replaced with A, G, I, L, S, M, or V; Y187 replaced with F, or W; A188 replaced with G, I, L, S, T, M, or V; M189 replaced with A, G, I, L, S, T, or V; G190 replaced with A, I, L, S, T, M, or V; H191 replaced with K, or R; L192 replaced with A, G, I, S, T, M, or V; I193 replaced with A, G, L, S, T, M, or V; Q194 replaced with N; R195 replaced with H, or K; K196 replaced with H, or R; K197 replaced with H, or R; V198 replaced with A, G, I, L, S, T, or M; H199 replaced with K, or R; V200 replaced with A, G, I, L, S, T, or M; F201 replaced with W, or Y; G202 replaced with A, I, L, S, T, M, or V; D203 replaced with E; E204 replaced with D; L205 replaced with A, G, I, S, T, M, or V; S206 replaced with A, G, I, L, T, M, or V; L207 replaced with A, G, I, S, T, M, or V; V208 replaced with A, G, I, L, S, T, or M; T209 replaced with A, G, I, L, S, M, or V; L210 replaced with A, G, I, S, T, M, or V; F211 replaced with W, or Y; R212 replaced with H, or K; I214 replaced with A, G, L, S, T, M, or V; Q215 replaced with N; N216 replaced with Q; M217 replaced with A, G, I, L, S, T, or V; E219 replaced with D; T220 replaced with A, G, I, L, S, M, or V; L221 replaced with A, G, I, S, T, M, or V; N223 replaced with Q; N224 replaced with Q; S225 replaced with A, G, I, L, T, M, or V; Y227 replaced with F, or W; S228 replaced with A, G, I, L, T, M, or V; A229 replaced with G, I, L, S, T, M, or V; G230 replaced with A, I, L, S, T, M, or V; I231 replaced with A, G, L, S, T, M, or V; A232 replaced with G, I, L, S, T, M, or V; K233 replaced with H, or R; L234 replaced with A, G, I, S, T, M, or V; E235 replaced with D; E236 replaced with D; G237 replaced with A, I, L, S, T, M, or V; D238 replaced with E; E239 replaced with D; L240 replaced with A, G, I, S, T, M, or V; Q241 replaced with N; L242 replaced with A, G, I, S, T, M, or V; A243 replaced with G, I, L, S, T, M, or V; I244 replaced with A, G, L, S, T, M, or V; R246 replaced with H, or K; E247 replaced with D; N248 replaced with Q; A249 replaced with G, I, L, S, T, M, or V; Q250 replaced with N; I251 replaced with A, G, L, S, T, M, or V; S252 replaced with A, G, I, L, T, M, or V; L253 replaced with A, G, I, S, T, M, or V; D254 replaced with E; G255 replaced with A, I, L, S, T, M, or V; D256 replaced with E; V257 replaced with A, G, I, L, S, T, or M; T258 replaced with A, G, I, L, S, M, or V; F259 replaced with W, or Y; F260 replaced with W, or Y; G261 replaced with A, I, L, S, T, M, or V; A262 replaced with G, I, L, S, T, M, or V; L263 replaced with A, G, I, S, T, M, or V; K264 replaced with H, or R; L265 replaced with A, G, I, S, T, M, or V; and/or L266 replaced with A, G, I, S, T, M, or V.

In another embodiment, site directed changes at the amino acid level of B Lymphocyte Stimulator can be made by replacing a particular amino acid with a conservative substitution. Antibodies of the present invention may bind B Lymphocyte Stimulator amino acid sequences containing conservative substitution mutations of the polypeptide of any one of SEQ ID NOS:3230–3237.

Amino acids in the B Lymphocyte Stimulator polypeptides that are essential for function can be identified by methods known in the art, such as site-directed mutagenesis or alanine-scanning mutagenesis (Cunningham and Wells, *Science* 244:1081–1085 (1989)). The latter procedure introduces single alanine mutations at every residue in the molecule. The resulting mutant molecules are then tested for functional activity, such ligand binding and the ability to stimulate lymphocyte (e.g., B cell) as, for example, proliferation, differentiation, and/or activation. Accordingly, antibodies of the present invention may bind amino acids in the B Lymphocyte Stimulator polypeptides that are essential for function. In preferred embodiments, antibodies of the present invention bind amino acids in the B Lymphocyte Stimulator polypeptides that are essential for function and inhibit B Lymphocyte Stimulator polypeptide function. In other preferred embodiments, antibodies of the present invention bind amino acids in the B Lymphocyte Stimulator polypeptides that are essential for function and enhance B Lymphocyte Stimulator polypeptide function.

Of special interest are substitutions of charged amino acids with other charged or neutral amino acids which may produce proteins with highly desirable improved characteristics, such as less aggregation. Aggregation may not only reduce activity but also be problematic when preparing pharmaceutical formulations, because aggregates can be immunogenic (Pinckard et al., *Clin. Exp. Immunol.* 2:331–340 (1967); Robbins et al., Diabetes 36: 838–845 (1987); Cleland et al., *Crit. Rev. Therapeutic Drug Carrier Systems* 10:307–377 (1993).

In another embodiment, the invention provides for antibodies that bind polypeptides having amino acid sequences containing non-conservative substitutions of the amino acid sequence provided in SEQ ID NO:3228. For example, non-conservative substitutions of the B Lymphocyte Stimulator protein sequence provided in SEQ ID NO:3228 include: M1 replaced with D, E, H, K, R, N, Q, F, W, Y, P, or C; D2 replaced with H, K, R, A, G, I, L, S, T, M, V, N, Q, F, W, Y, P, or C; D3 replaced with H, K, R, A, G, I, L, S, T, M, V, N, Q, F, W, Y, P, or C; S4 replaced with D, E, H, K, R, N, Q, F, W, Y, P, or C; T5 replaced with D, E, H, K, R, N, Q, F, W, Y, P, or C; E6 replaced with H, K, R, A, G, I, L, S, T, M, V, N, Q, F, W, Y, P, or C; R7 replaced with D, E, A, G, I, L, S, T, M, V, N, Q, F, W, Y, P, or C; E8 replaced with H, K, R, A, G, I, L, S, T, M, V, N, Q, F, W, Y, P, or C; Q9 replaced with D, E, H, K, R, A, G, I, L, S, T, M, V, F, W, Y, P, or C; S10 replaced with D, E, H, K, R, N, Q, F, W, Y, P, or C; R11 replaced with D, E, A, G, I, L, S, T, M, V, N, Q, F, W, Y, P, or C; L12 replaced with D, E, H, K, R, N, Q, F, W, Y, P, or C; T13 replaced with D, E, H, K, R, N, Q, F, W, Y, P, or C; S14 replaced with D, E, H, K, R, N, Q, F, W, Y, P, or C; C15 replaced with D, E, H, K, R, A, G, I, L, S, T, M, V, N, Q, F, W, Y, or P; L16 replaced with D, E, H, K, R, N, Q, F, W, Y, P, or C; K17 replaced with D, E, A, G, I, L, S, T, M, V, N, Q, F, W, Y, P, or C; K18 replaced with D, E, A, G, I, L, S, T, M, V, N, Q, F, W, Y, P, or C; R19 replaced with D, E, A, G, I, L, S, T, M, V, N, Q, F, W, Y, P, or C; E20 replaced with H, K, R, A, G, I, L, S, T, M, V, N, Q, F, W, Y, P, or C; E21 replaced with H, K, R, A, G, I, L, S, T, M, V, N, Q, F, W, Y, P, or C; M22 replaced with D, E, H, K, R, N, Q, F, W, Y, P, or C; K23 replaced with D, E, A, G, I, L, S, T, M, V, N, Q, F, W, Y, P, or C; L24 replaced with D, E, H, K, R, N, Q, F, W, Y, P, or C; K25 replaced with D, E, A, G, I, L, S, T, M, V, N, Q, F, W, Y, P, or C; E26 replaced with H, K, R, A, G, I, L, S, T, M, V, N, Q, F, W, Y, P, or C; C27 replaced with D, E, H, K, R, A, G, I, L, S, T, M, V, N, Q, F, W, Y, or P; V28 replaced with D, E, H, K, R, N, Q, F, W, Y, P, or C; S29 replaced with D, E, H, K, R, N, Q, F, W, Y, P, or C; I30 replaced with D, E, H, K, R, N, Q, F, W, Y, P, or C; L31 replaced with D, E, H, K, R, N, Q, F, W, Y, P, or C; P32 replaced with D, E, H, K, R, A, G, I, L, S, T, M, V, N, Q, F, W, Y, or C; R33 replaced with D, E, A, G, I, L, S, T, M, V, N, Q, F, W, Y, P, or C; K34 replaced with D, E, A, G, I, L, S, T, M, V, N, Q, F, W, Y, P, or C; E35 replaced with H, K, R, A, G, I, L, S, T, M, V, N, Q, F, W, Y, P, or C; S36 replaced with D, E, H, K, R, N, Q, F, W, Y, P, or C; P37 replaced with D, E, H, K, R, A, G, I, L, S, T, M, V, N, Q, F, W, Y, or C; S38 replaced with D, E, H, K, R, N, Q, F, W, Y, P, or C; V39 replaced with D, E, H, K, R, N, Q, F, W, Y, P, or C; R40 replaced with D, E, A, G, I, L, S, T, M, V, N, Q, F, W, Y, P, or C; S41 replaced with D, E, H, K, R, N, Q, F, W, Y, P, or C; S42 replaced with D, E, H, K, R, N, Q, F, W, Y, P, or C; K43 replaced with D, E, A, G, I, L, S, T, M, V, N, Q, F, W, Y, P, or C; D44 replaced with H, K, R, A, G, I, L, S, T, M, V, N, Q, F, W, Y, P, or C; G45 replaced with D, E, H, K, R, N, Q, F, W, Y, P, or C; K46 replaced with D, E, A, G, I, L, S, T, M, V, N, Q, F, W, Y, P, or C; L47 replaced with D, E, H, K, R, N, Q, F, W, Y, P, or C; L48 replaced with D, E, H, K, R, N, Q, F, W, Y, P, or C; A49 replaced with D, E, H, K, R, N, Q, F, W, Y, P, or C; A50 replaced with D, E, H, K, R, N, Q, F, W, Y, P, or C; T51 replaced with D, E, H, K, R, N, Q, F, W, Y, P, or C; L52 replaced with D, E, H, K, R, N, Q, F, W, Y, P, or C; L53 replaced with D, E, H, K, R, N, Q, F, W, Y, P, or C; L54 replaced with D, E, H, K, R, N, Q, F, W, Y, P, or C; A55 replaced with D, E, H, K, R, N, Q, F, W, Y, P, or C; L56 replaced with D, E, H, K, R, N, Q, F, W, Y, P, or C; L57 replaced with D, E, H, K, R, N, Q, F, W, Y, P, or C; S58 replaced with D, E, H, K, R, N, Q, F, W, Y, P, or C; C59 replaced with D, E, H, K, R, A, G, I, L, S, T, M, V, N, Q, F, W, Y, or P; C60 replaced with D, E, H, K, R, A, G, I, L, S, T, M, V, N, Q, F, W, Y, or P; L61 replaced with D, E, H, K, R, N, Q, F, W, Y, P, or C; T62 replaced with D, E, H, K, R, N, Q, F, W, Y, P, or C; V63 replaced with D, E, H, K, R, N, Q, F, W, Y, P, or C; V64 replaced with D, E, H, K, R, N, Q, F, W, Y, P, or C; S65 replaced with D, E, H, K, R, N, Q, F, W, Y, P, or C; F66 replaced with D, E, H, K, R, N, Q, A, G, I, L, S, T, M, V, P, or C; Y67 replaced with D, E, H, K, R, N, Q, A, G, I, L, S, T, M, V, P, or C; Q68 replaced with D, E, H, K, R, A, G, I, L, S, T, M, V, F, W, Y, P, or C; V69 replaced with D, E, H, K, R, N, Q, F, W, Y, P, or C; A70 replaced with D, E, H, K, R, N, Q, F, W, Y, P, or C; A71 replaced with D, E, H, K, R, N, Q, F, W, Y, P, or C; L72 replaced with D, E, H, K, R, N, Q, F, W, Y, P, or C; Q73 replaced with D, E, H, K, R, A, G, I, L, S, T, M, V, F, W, Y, P, or C; G74 replaced with D, E, H, K, R, N, Q, F, W, Y, P, or C; D75 replaced with H, K, R, A, G, I, L, S, T, M, V, N, Q, F, W, Y, P, or C; L76 replaced with D, E, H, K, R, N, Q, F, W, Y, P, or C; A77 replaced with D, E, H, K, R, N, Q, F, W, Y, P, or C; S78 replaced with D, E, H, K, R, N, Q, F, W, Y, P, or C; L79 replaced with D, E, H, K, R, N, Q, F, W, Y, P, or C; R80 replaced with D, E, A, G, I, L, S, T, M, V, N, Q, F, W, Y, P, or C; A81 replaced with D, E, H, K, R, N, Q, F, W, Y, P, or C; E82 replaced with H, K, R, A, G, I, L, S, T, M, V, N, Q, F, W, Y, P, or C; L83 replaced with D, E, H, K, R, N, Q, F, W, Y, P, or C; Q84 replaced with D, E, H, K, R, A, G, I, L, S, T, M, V, F, W, Y, P, or C; G85 replaced with D, E, H, K, R, N, Q, F, W, Y, P, or C; H86 replaced with D, E, A, G, I, L, S, T, M, V, N, Q, F, W, Y, P, or C; H87 replaced with D, E, A, G, I, L, S, T, M, V, N, Q, F, W, Y, P, or C; A88 replaced with D, E, H, K, R, N, Q, F, W, Y, P, or C; E89 replaced with H, K, R, A, G, I, L, S, T, M, V, N, Q, F, W, Y, P, or C; K90 replaced with D, E, A, G, I, L, S, T, M, V, N, Q, F, W, Y, P, or C; L91 replaced with D, E, H, K, R, N, Q, F, W, Y, P, or C; P92 replaced with D, E, H, K, R, A, G, I, L, S, T, M, V, N, Q, F, W, Y, or C; A93 replaced with D, E, H, K, R, N, Q, F, W, Y, P, or C; G94 replaced with D, E, H, K, R, N, Q, F, W, Y, P, or C; A95 replaced with D, E, H, K, R, N, Q, F, W, Y, P, or C; G96 replaced with D, E, H, K, R, N, Q, F, W, Y, P, or C; A97 replaced with D, E, H, K, R, N, Q, F, W, Y, P, or C; P98 replaced with D, E, H, K, R, A, G, I, L, S, T, M, V, N, Q, F, W, Y, or C; K99 replaced with D, E, A, G, I, L, S, T, M, V, N, Q, F, W, Y, P, or C; A100 replaced with D, E, H, K, R, N, Q, F, W, Y, P, or C; G101 replaced with D, E, H, K, R, N, Q, F, W, Y, P, or C; L102 replaced with D, E, H, K, R, N, Q, F, W, Y, P, or C; E103 replaced with H, K, R, A, G, I, L, S, T, M, V, N, Q, F, W, Y, P, or C; E104 replaced with H, K, R, A, G, I, L, S, T, M, V, N, Q, F, W, Y, P, or C; A105 replaced with D, E, H, K, R, N, Q, F, W, Y, P, or C; P106 replaced with D, E, H, K, R, A, G, I, L, S, T, M, V, N, Q, F, W, Y, or C; A107 replaced with D, E, H, K, R, N, Q, F, W, Y, P, or C; V108 replaced with D, E, H, K, R, N, Q, F, W, Y, P, or C; T109 replaced with D, E, H, K, R, N, Q, F, W, Y, P, or C; A110 replaced with D, E, H, K, R, N, Q, F, W, Y, P, or C; G111 replaced with D, E, H, K, R, N, Q, F, W, Y, P, or C; L112 replaced with D, E, H, K, R, N, Q, F, W, Y, P, or C; K113 replaced with D, E, A, G, I, L, S, T, M, V, N, Q, F, W, Y, P, or C; I114 replaced with D, E, H, K, R, N, Q, F, W, Y, P, or C; F115 replaced with D, E, H, K, R, N, Q, A, G, I, L, S, T, M, V, P, or C; E116 replaced with H, K, R, A, G, I, L, S, T, M, V, N, Q, F, W, Y, P, or C; P117 replaced with D, E, H, K, R, A, G, I, L, S, T, M, V, N, Q, F, W, Y, or C; P118 replaced with D, E, H, K, R, A, G, I, L, S, T, M, V, N, Q, F, W, Y, or C; A119 replaced with D, E, H, K, R, N, Q, F, W, Y, P, or C; P120 replaced with D, E, H, K, R, A, G, I, L, S, T, M, V, N, Q, F, W, Y, or C; G121 replaced with D, E, H, K, R, N, Q, F, W, Y, P, or C; E122 replaced with H, K, R, A, G, I, L, S, T, M, V, N, Q, F, W, Y, P, or C; G123 replaced with D, E, H, K, R, N, Q, F, W, Y, P, or C; N124 replaced with D, E, H, K, R, A, G, I, L, S, T, M, V, F, W, Y, P, or C; S125 replaced with D, E, H, K, R, N, Q, F, W, Y, P, or C; S126 replaced with D, E, H, K, R, N, Q, F, W, Y, P, or C; Q127 replaced with D, E, H, K, R, A, G, I, L, S, T, M, V, F, W, Y, P, or C; N128 replaced with D, E, H, K, R, A, G, I, L, S, T, M, V, F, W, Y, P, or C; S129 replaced with D, E, H, K, R, N, Q, F, W, Y, P, or C; R130 replaced with D, E, A, G, I, L, S, T, M, V, N, Q, F, W, Y, P, or C; N131 replaced with D, E, H, K, R, A, G, I, L, S, T, M, V, F, W, Y, P, or C; K132 replaced with D, E, A, G, I, L, S, T, M, V, N, Q, F, W, Y, P, or C; R133 replaced with D, E, A, G, I, L, S, T, M, V, N, Q, F, W, Y, P, or C; A134 replaced with D, E, H, K, R, N, Q, F, W, Y, P, or C; V135 replaced with D, E, H, K, R, N, Q, F, W, Y, P, or C; Q136 replaced with D, E, H, K, R, A, G, I, L, S, T, M, V, F, W, Y, P, or C; G137 replaced with D, E, H, K, R, N, Q, F, W, Y, P, or C; P138 replaced with D, E, H, K, R, A, G, I, L, S, T, M, V, N, Q, F, W, Y, or C; E139 replaced with H, K, R, A, G, I, L, S, T, M, V, N, Q, F, W, Y, P, or C; E140 replaced with H, K, R, A, G, I, L, S, T, M, V, N, Q, F, W, Y, P, or C; T141 replaced with D, E, H, K, R, N, Q, F, W, Y, P, or C; V142 replaced with D, E, H, K, R, N, Q, F, W, Y, P, or C; T143 replaced with D, E, H, K, R, N, Q, F, W, Y, P, or C; Q144 replaced with D, E, H, K, R, A, G, I, L, S, T, M, V, F, W, Y, P, or C; D145 replaced with H, K, R, A, G, I, L, S, T, M, V, N, Q, F, W, Y, P, or C; C146 replaced with D, E, H, K, R, A, G, I, L, S, T, M, V, N, Q, F, W, Y, or P; L147 replaced with D, E, H, K, R, N, Q, F, W, Y, P, or C; Q148 replaced with D, E, H, K, R, A, G, I, L, S, T, M, V, F, W, Y, P, or C; L149 replaced with D, E, H, K, R, N, Q, F, W, Y, P, or C; I150 replaced with D, E, H, K, R, N, Q, F, W, Y, P, or C; A151 replaced with D, E, H, K, R, N, Q, F, W, Y, P, or C; D152 replaced with H, K, R, A, G, I, L, S, T, M, V, N, Q, F, W, Y, P, or C; S153 replaced with D, E, H, K, R, N, Q, F, W, Y, P, or C; E154 replaced with H, K, R, A, G, I, L, S, T, M, V, N, Q, F, W, Y, P, or C; T155 replaced with D, E, H, K, R, N, Q, F, W, Y, P, or C; P156 replaced with D, E, H, K, R, A, G, I, L, S, T, M, V, N, Q, F, W, Y, or C; T157 replaced with D, E, H, K, R, N, Q, F, W, Y, P, or C; I158 replaced with D, E, H, K, R, N, Q, F, W, Y, P, or C; Q159 replaced with D, E, H, K, R, A, G, I, L, S, T, M, V, F, W, Y, P, or C; K160 replaced with D, E, A, G, I, L, S, T, M, V, N, Q, F, W, Y, P, or C; G161 replaced with D, E, H, K, R, N, Q, F, W, Y, P, or C; S162 replaced with D, E, H, K, R, N, Q, F, W, Y, P, or C; Y163 replaced with D, E, H, K, R, N, Q, A, G, I, L, S, T, M, V, P, or C; T164 replaced with D, E, H, K, R, N, Q, F, W, Y, P, or C; F165 replaced with D, E, H, K, R, N, Q, A, G, I, L, S, T, M, V, P, or C; V166 replaced with D, E, H, K, R, N, Q, F, W, Y, P, or C; P167 replaced with D, E, H, K, R, A, G, I, L, S, T, M, V, N, Q, F, W, Y, or C; W168 replaced with D, E, H, K, R, N, Q, A, G, I, L, S, T, M, V, P, or C; L169 replaced with D, E, H, K, R, N, Q, F, W, Y, P, or C; L170 replaced with D, E, H, K, R, N, Q, F, W, Y, P, or C; S171 replaced with D, E, H, K, R, N, Q, F, W, Y, P, or C; F172 replaced with D, E, H, K, R, N, Q, A, G, I, L, S, T, M, V, P, or C; K173 replaced with D, E, A, G, I, L, S, T, M, V, N, Q, F, W, Y, P, or C; R174 replaced with D, E, A, G, I, L, S, T, M, V, N, Q, F, W, Y, P, or C; G175 replaced with D, E, H, K, R, N, Q, F, W, Y, P, or C; S176 replaced with D, E, H, K, R, N, Q, F, W, Y, P, or C; A177 replaced with D, E, H, K, R, N, Q, F, W, Y, P, or C; L178 replaced with D, E, H, K, R, N, Q, F, W, Y, P, or C; E179 replaced with H, K, R, A, G, I, L, S, T, M, V, N, Q, F, W, Y, P, or C; E180 replaced with H, K, R, A, G, I, L, S, T, M, V, N, Q, F, W, Y, P, or C; K181 replaced with D, E, A, G, I, L, S, T, M, V, N, Q, F, W, Y, P, or C; E182 replaced with H, K, R, A, G, I, L, S, T, M, V, N, Q, F, W, Y, P, or C; N183 replaced with D, E, H, K, R, A, G, I, L, S, T, M, V, F, W, Y, P, or C; K184 replaced with D, E, A, G, I, L, S, T, M, V, N, Q, F, W, Y, P, or C; I185 replaced with D, E, H, K, R, N, Q, F, W, Y, P, or C; L186 replaced with D, E, H, K, R, N, Q, F, W, Y, P, or C; V187 replaced with D, E, H, K, R, N, Q, F, W, Y, P, or C; K188 replaced with D, E, A, G, I, L, S, T, M, V, N, Q, F, W, Y, P, or C; E189 replaced with H, K, R, A, G, I, L, S, T, M, V, N, Q, F, W, Y, P, or C; T190 replaced with D, E, H, K, R, N, Q, F, W, Y, P, or C; G191 replaced with D, E, H, K, R, N, Q, F, W, Y, P, or C; Y192 replaced with D, E, H, K, R, N, Q, A, G, I, L, S, T, M, V, P, or C; F193 replaced with D, E, H, K, R, N, Q, A, G, I, L, S, T, M, V, P, or C; F194 replaced with D, E, H, K, R, N, Q, A, G, I, L, S, T, M, V, P, or C; I195 replaced with D, E, H, K, R, N, Q, F, W, Y, P, or C; Y196 replaced with D, E, H, K, R, N, Q, A, G, I, L, S, T, M, V, P, or C; G197 replaced with D, E, H, K, R, N, Q, F, W, Y, P, or C; Q198 replaced with D, E, H, K, R, A, G, I, L, S, T, M, V, F, W, Y, P, or C; V199 replaced with D, E, H, K, R, N, Q, F, W, Y, P, or C; L200 replaced with D, E, H, K, R, N, Q, F, W, Y, P, or C; Y201 replaced with D, E, H, K, R, N, Q, A, G, I, L, S, T, M, V, P, or C; T202 replaced with D, E, H, K, R, N, Q, F, W, Y, P, or C; D203 replaced with H, K, R, A, G, I, L, S, T, M, V, N, Q, F, W, Y, P, or C; K204 replaced with D, E, A, G, I, L, S, T, M, V, N, Q, F, W, Y, P, or C; T205 replaced with D, E, H, K, R, N, Q, F, W, Y, P, or C; Y206 replaced with D, E, H, K, R, N, Q, A, G, I, L, S, T, M, V, P, or C; A207 replaced with D, E, H, K, R, N, Q, F, W, Y, P, or C; M208 replaced with D, E, H, K, R, N, Q, F, W, Y, P, or C; G209 replaced with D, E, H, K, R, N, Q, F, W, Y, P, or C; H210 replaced with D, E, A, G, I, L, S, T, M, V, N, Q, F, W, Y, P, or C; L211 replaced with D, E, H, K, R, N, Q, F, W, Y, P, or C; I212 replaced with D, E, H, K, R, N, Q, F, W, Y, P, or C; Q213 replaced with D, E, H, K, R, A, G, I, L, S, T, M, V, F, W, Y, P, or C; R214 replaced with D, E, A, G, I, L, S, T, M, V, N, Q, F, W, Y, P, or C; K215 replaced with D, E, A, G, I, L, S, T, M, V, N, Q, F, W, Y, P, or C; K216 replaced with D, E, A, G, I, L, S, T, M, V, N, Q, F, W, Y, P, or C; V217 replaced with D, E, H, K, R, N, Q, F, W, Y, P, or C; H218 replaced with D, E, A, G, I, L, S, T, M, V, N, Q, F, W, Y, P, or C; V219 replaced with D, E, H, K, R, N, Q, F, W, Y, P, or C; F220 replaced with D, E, H, K, R, N, Q, A, G, I, L, S, T, M, V, P, or C; G221 replaced with D, E, H, K, R, N, Q, F, W, Y, P, or C; D222 replaced with H, K, R, A, G, I, L, S, T, M, V, N, Q, F, W, Y, P, or C; E223 replaced with H, K, R, A, G, I, L, S, T, M, V, N, Q, F, W, Y, P, or C; L224 replaced with D, E, H, K, R, N, Q, F, W, Y, P, or C; S225 replaced with D, E, H, K, R, N, Q, F, W, Y, P, or C; L226 replaced with D, E, H, K, R, N, Q, F, W, Y, P, or C; V227 replaced with D, E, H, K, R, N, Q, F, W, Y, P, or C; T228 replaced with D, E, H, K, R, N, Q, F, W, Y, P, or C; L229 replaced with D, E, H, K, R, N, Q, F, W, Y, P, or C; F230 replaced with D, E, H, K, R, N, Q, A, G, I, L, S, T, M, V, P, or C; R231 replaced with D, E, A, G, I, L, S, T, M, V, N, Q, F, W, Y, P, or C; C232 replaced with D, E, H, K, R, A, G, I, L, S, T, M, V, N, Q, F, W, Y, or P; I233 replaced with D, E, H, K, R, N, Q, F, W, Y, P, or C; Q234 replaced with D, E, H, K, R, A, G, I, L, S, T, M, V, F, W, Y, P, or C; N235 replaced with D, E, H, K, R, A, G, I, L, S, T, M, V, F, W, Y, P, or C; M236 replaced with D, E, H, K, R, N, Q, F, W, Y, P, or C; P237 replaced with D, E, H, K, R, A, G, I, L, S, T, M, V, N, Q, F, W, Y, or C; E238 replaced with H, K, R, A, G, I, L, S, T, M, V, N, Q, F, W, Y, P, or C; T239 replaced with D, E, H, K, R, N, Q, F, W, Y, P, or C; L240 replaced with D, E, H, K, R, N, Q, F, W, Y, P, or C; P241 replaced with D, E, H, K, R, A, G, I, L, S, T, M, V, N, Q, F, W, Y, or C; N242 replaced with D, E, H, K, R, A, G, I, L, S, T, M, V, F, W, Y, P, or C; N243 replaced with D, E, H, K, R, A, G, I, L, S, T, M, V, F, W, Y, P, or C; S244 replaced with D, E, H, K, R, N, Q, F, W, Y, P, or C; C245 replaced with D, E, H, K, R, A, G, I, L, S, T, M, V, N, Q, F, W, Y, or P; Y246 replaced with D, E, H, K, R, N, Q, A, G, I, L, S, T, M, V, P, or C; S247 replaced with D, E, H, K, R, N, Q, F, W, Y, P, or C; A248 replaced with D, E, H, K, R, N, Q, F, W, Y, P, or C; G249 replaced with D, E, H, K, R, N, Q, F, W, Y, P, or C; I250 replaced with D, E, H, K, R, N, Q, F, W, Y, P, or C; A251 replaced with D, E, H, K, R, N, Q, F, W, Y, P, or C; K252 replaced with D, E, A, G, I, L, S, T, M, V, N, Q, F, W, Y, P, or C; L253 replaced with D, E, H, K, R, N, Q, F, W, Y, P, or C; E254 replaced with H, K, R, A, G, I, L, S, T, M, V, N, Q, F, W, Y, P, or C; E255 replaced with H, K, R, A, G, I, L, S, T, M, V, N, Q, F, W, Y, P, or C; G256 replaced with D, E, H, K, R, N, Q, F, W, Y, P, or C; D257 replaced with H, K, R, A, G, I, L, S, T, M, V, N, Q, F, W, Y, P, or C; E258 replaced with H, K, R, A, G, I, L, S, T, M, V, N, Q, F, W, Y, P, or C; L259 replaced with D, E, H, K, R, N, Q, F, W, Y, P, or C; Q260 replaced with D, E, H, K, R, A, G, I, L, S, T, M, V, F, W, Y, P, or C; L261 replaced with D, E, H, K, R, N, Q, F, W, Y, P, or C; A262 replaced with D, E, H, K, R, N, Q, F, W, Y, P, or C; I263 replaced with D, E, H, K, R, N, Q, F, W, Y, P, or C; P264 replaced with D, E, H, K, R, A, G, I, L, S, T, M, V, N, Q, F, W, Y, or C; R265 replaced with D, E, A, G, I, L, S, T, M, V, N, Q, F, W, Y, P, or C; E266 replaced with H, K, R, A, G, I, L, S, T, M, V, N, Q, F, W, Y, P, or C; N267 replaced with D, E, H, K, R, A, G, I, L, S, T, M, V, F, W, Y, P, or C; A268 replaced with D, E, H, K, R, N, Q, F, W, Y, P, or C; Q269 replaced with D, E, H, K, R, A, G, I, L, S, T, M, V, F, W, Y, P, or C; I270 replaced with D, E, H, K, R, N, Q, F, W, Y, P, or C; S271 replaced with D, E, H, K, R, N, Q, F, W, Y, P, or C; L272 replaced with D, E, H, K, R, N, Q, F, W, Y, P, or C; D273 replaced with H, K, R, A, G, I, L, S, T, M, V, N, Q, F, W, Y, P, or C; G274 replaced with D, E, H, K, R, N, Q, F, W, Y, P, or C; D275 replaced with H, K, R, A, G, I, L, S, T, M, V, N, Q, F, W, Y, P, or C; V276 replaced with D, E, H, K, R, N, Q, F, W, Y, P, or C; T277 replaced with D, E, H, K, R, N, Q, F, W, Y, P, or C; F278 replaced with D, E, H, K, R, N, Q, A, G, I, L, S, T, M, V, P, or C; F279 replaced with D, E, H, K, R, N, Q, A, G, I, L, S, T, M, V, P, or C; G280 replaced with D, E, H, K, R, N, Q, F, W, Y, P, or C; A281 replaced with D, E, H, K, R, N, Q, F, W, Y, P, or C; L282 replaced with D, E, H, K, R, N, Q, F, W, Y, P, or C; K283 replaced with D, E, A, G, I, L, S, T, M, V, N, Q, F, W, Y, P, or C; L284 replaced with D, E, H, K, R, N, Q, F, W, Y, P, or C; and/or L285 replaced with D, E, H, K, R, N, Q, F, W, Y, P, or C.

In an additional embodiment, antibodies of the present invention bind B Lymphocyte Stimulator polypeptides comprising, or alternatively consisting of, a B Lymphocyte Stimulator amino acid sequence in which more than one amino acid (e.g., 2, 3, 4, 5, 6, 7, 8, 9, 10, 15, 20, 30 and 50) is replaced with the substituted amino acids as described above (either conservative or nonconservative).

In another embodiment of the invention, antibodies of the present invention bind B Lymphocyte Stimulator polypeptides with non-conservative substitutions of the sequence provided in SEQ ID NO:3229 including: M1 replaced with D, E, H, K, R, N, Q, F, W, Y, P, or C; D2 replaced with H, K, R, A, G, I, L, S, T, M, V, N, Q, F, W, Y, P, or C; D3 replaced with H, K, R, A, G, I, L, S, T, M, V, N, Q, F, W, Y, P, or C; S4 replaced with D, E, H, K, R, N, Q, F, W, Y, P, or C; T5 replaced with D, E, H, K, R, N, Q, F, W, Y, P, or C; E6 replaced with H, K, R, A, G, I, L, S, T, M, V, N, Q, F, W, Y, P, or C; R7 replaced with D, E, A, G, I, L, S, T, M, V, N, Q, F, W, Y, P, or C; E8 replaced with H, K, R, A, G, I, L, S, T, M, V, N, Q, F, W, Y, P, or C; Q9 replaced with D, E, H, K, R, A, G, I, L, S, T, M, V, F, W, Y, P, or C; S10 replaced with D, E, H, K, R, N, Q, F, W, Y, P, or C; R11 replaced with D, E, A, G, I, L, S, T, M, V, N, Q, F, W, Y, P, or C; L12 replaced with D, E, H, K, R, N, Q, F, W, Y, P, or C; T13 replaced with D, E, H, K, R, N, Q, F, W, Y, P, or C; S14 replaced with D, E, H, K, R, N, Q, F, W, Y, P, or C; C15 replaced with D, E, H, K, R, A, G, I, L, S, T, M, V, N, Q, F, W, Y, or P; L16 replaced with D, E, H, K, R, N, Q, F, W, Y, P, or C; K17 replaced with D, E, A, G, I, L, S, T, M, V, N, Q, F, W, Y, P, or C; K18 replaced with D, E, A, G, I, L, S, T, M, V, N, Q, F, W, Y, P, or C; R19 replaced with D, E, A, G, I, L, S, T, M, V, N, Q, F, W, Y, P, or C; E20 replaced with H, K, R, A, G, I, L, S, T, M, V, N, Q, F, W, Y, P, or C; E21 replaced with H, K, R, A, G, I, L, S, T, M, V, N, Q, F, W, Y, P, or C; M22 replaced with D, E, H, K, R, N, Q, F, W, Y, P, or C; K23 replaced with D, E, A, G, I, L, S, T, M, V, N, Q, F, W, Y, P, or C; L24 replaced with D, E, H, K, R, N, Q, F, W, Y, P, or C; K25 replaced with D, E, A, G, I, L, S, T, M, V, N, Q, F, W, Y, P, or C; E26 replaced with H, K, R, A, G, I, L, S, T, M, V, N, Q, F, W, Y, P, or C; C27 replaced with D, E, H, K, R, A, G, I, L, S, T, M, V, N, Q, F, W, Y, or P; V28 replaced with D, E, H, K, R, N, Q, F, W, Y, P, or C; S29 replaced with D, E, H, K, R, N, Q, F, W, Y, P, or C; I30 replaced with D, E, H, K, R, N, Q, F, W, Y, P, or C; L31 replaced with D, E, H, K, R, N, Q, F, W, Y, P, or C; P32 replaced with D, E, H, K, R, A, G, I, L, S, T, M, V, N, Q, F, W, Y, or C; R33 replaced with D, E, A, G, I, L, S, T, M, V, N, Q, F, W, Y, P, or C; K34 replaced with D, E, A, G, I, L, S, T, M, V, N, Q, F, W, Y, P, or C; E35 replaced with H, K, R, A, G, I, L, S, T, M, V, N, Q, F, W, Y, P, or C; S36 replaced with D, E, H, K, R, N, Q, F, W, Y, P, or C; P37 replaced with D, E, H, K, R, A, G, I, L, S, T, M, V, N, Q, F, W, Y, or C; S38 replaced with D, E, H, K, R, N, Q, F, W, Y, P, or C; V39 replaced with D, E, H, K, R, N, Q, F, W, Y, P, or C; R40 replaced with D, E, A, G, I, L, S, T, M, V, N, Q, F, W, Y, P, or C; S41 replaced with D, E, H, K, R, N, Q, F, W, Y, P, or C; S42 replaced with D, E, H, K, R, N, Q, F, W, Y, P, or C; K43 replaced with D, E, A, G, I, L, S, T, M, V, N, Q, F, W, Y, P, or C; D44 replaced with H, K, R, A, G, I, L, S, T, M, V, N, Q, F, W, Y, P, or C; G45 replaced with D, E, H, K, R, N, Q, F, W, Y, P, or C; K46 replaced with D, E, A, G, I, L, S, T, M, V, N, Q, F, W, Y, P, or C; L47 replaced with D, E, H, K, R, N, Q, F, W, Y, P, or C; L48 replaced with D, E, H, K, R, N, Q, F, W, Y, P, or C; A49 replaced with D, E, H, K, R, N, Q, F, W, Y, P, or C; A50 replaced with D, E, H, K, R, N, Q, F, W, Y, P, or C; T51 replaced with D, E, H, K, R, N, Q, F, W, Y, P, or C; L52 replaced with D, E, H, K, R, N, Q, F, W, Y, P, or C; L53 replaced with D, E, H, K, R, N, Q, F, W, Y, P, or C; L54 replaced with D, E, H, K, R, N, Q, F, W, Y, P, or C; A55 replaced with D, E, H, K, R, N, Q, F, W, Y, P, or C; L56 replaced with D, E, H, K, R, N, Q, F, W, Y, P, or C; L57 replaced with D, E, H, K, R, N, Q, F, W, Y, P, or C; S58 replaced with D, E, H, K, R, N, Q, F, W, Y, P, or C; C59 replaced with D, E, H, K, R, A, G, I, L, S, T, M, V, N, Q, F, W, Y, or P; C60 replaced with D, E, H, K, R, A, G, I, L, S, T, M, V, N, Q, F, W, Y, or P; L61 replaced with D, E, H, K, R, N, Q, F, W, Y, P, or C; T62 replaced with D, E, H, K, R, N, Q, F, W, Y, P, or C; V63 replaced with D, E, H, K, R, N, Q, F, W, Y, P, or C; V64 replaced with D, E, H, K, R, N, Q, F, W, Y, P, or C; S65 replaced with D, E, H, K, R, N, Q, F, W, Y, P, or C; F66 replaced with D, E, H, K, R, N, Q, A, G, I, L, S, T, M, V, P, or C; Y67 replaced with D, E, H, K, R, N, Q, A, G, I, L, S, T, M, V, P, or C; Q68 replaced with D, E, H, K, R, A, G, I, L, S, T, M, V, F, W, Y, P, or C; V69 replaced with D, E, H, K, R, N, Q, F, W, Y, P, or C; A70 replaced with D, E, H, K, R, N, Q, F, W, Y, P, or C; A71 replaced with D, E, H, K, R, N, Q, F, W, Y, P, or C; L72 replaced with D, E, H, K, R, N, Q, F, W, Y, P, or C; Q73 replaced with D, E, H, K, R, A, G, I, L, S, T, M, V, F, W, Y, P, or C; G74 replaced with D, E, H, K, R, N, Q, F, W, Y, P, or C; D75 replaced with H, K, R, A, G, I, L, S, T, M, V, N, Q, F, W, Y, P, or C; L76 replaced with D, E, H, K, R, N, Q, F, W, Y, P, or C; A77 replaced with D, E, H, K, R, N, Q, F, W, Y, P, or C; S78 replaced with D, E, H, K, R, N, Q, F, W, Y, P, or C; L79 replaced with D, E, H, K, R, N, Q, F, W, Y, P, or C; R80 replaced with D, E, A, G, I, L, S, T, M, V, N, Q, F, W, Y, P, or C; A81 replaced with D, E, H, K, R, N, Q, F, W, Y, P, or C; E82 replaced with H, K, R, A, G, I, L, S, T, M, V, N, Q, F, W, Y, P, or C; L83 replaced with D, E, H, K, R, N, Q, F, W, Y, P, or C; Q84 replaced with D, E, H, K, R, A, G, I, L, S, T, M, V, F, W, Y, P, or C; G85 replaced with D, E, H, K, R, N, Q, F, W, Y, P, or C; H86 replaced with D, E, A, G, I, L, S, T, M, V, N, Q, F, W, Y, P, or C; H87 replaced with D, E, A, G, I, L, S, T, M, V, N, Q, F, W, Y, P, or C; A88 replaced with D, E, H, K, R, N, Q, F, W, Y, P, or C; E89 replaced with H, K, R, A, G, I, L, S, T, M, V, N, Q, F, W, Y, P, or C; K90 replaced with D, E, A, G, I, L, S, T, M, V, N, Q, F, W, Y, P, or C; L91 replaced with D, E, H, K, R, N, Q, F, W, Y, P, or C; P92 replaced with D, E, H, K, R, A, G, I, L, S, T, M, V, N, Q, F, W, Y, or C; A93 replaced with D, E, H, K, R, N, Q, F, W, Y, P, or C; G94 replaced with D, E, H, K, R, N, Q, F, W, Y, P, or C; A95 replaced with D, E, H, K, R, N, Q, F, W, Y, P, or C; G96 replaced with D, E, H, K, R, N, Q, F, W, Y, P, or C; A97 replaced with D, E, H, K, R, N, Q, F, W, Y, P, or C; P98 replaced with D, E, H, K, R, A, G, I, L, S, T, M, V, N, Q, F, W, Y, or C; K99 replaced with D, E, A, G, I, L, S, T, M, V, N, Q, F, W, Y, P, or C; A100 replaced with D, E, H, K, R, N, Q, F, W, Y, P, or C; G101 replaced with D, E, H, K, R, N, Q, F, W, Y, P, or C; L102 replaced with D, E, H, K, R, N, Q, F, W, Y, P, or C; E103 replaced with H, K, R, A, G, I, L, S, T, M, V, N, Q, F, W, Y, P, or C; E104 replaced with H, K, R, A, G, I, L, S, T, M, V, N, Q, F, W, Y, P, or C; A105 replaced with D, E, H, K, R, N, Q, F, W, Y, P, or C; P106 replaced with D, E, H, K, R, A, G, I, L, S, T, M, V, N, Q, F, W, Y, or C; A107 replaced with D, E, H, K, R, N, Q, F, W, Y, P, or C; V108 replaced with D, E, H, K, R, N, Q, F, W, Y, P, or C; T109 replaced with D, E, H, K, R, N, Q, F, W, Y, P, or C; A110 replaced with D, E, H, K, R, N, Q, F, W, Y, P, or C; G111 replaced with D, E, H, K, R, N, Q, F, W, Y, P, or C; L112 replaced with D, E, H, K, R, N, Q, F, W, Y, P, or C; K113 replaced with D, E, A, G, I, L, S, T, M, V, N, Q, F, W, Y, P, or C; I114 replaced with D, E, H, K, R, N, Q, F, W, Y, P, or C; F115 replaced with D, E, H, K, R, N, Q, A, G, I, L, S, T, M, V, P, or C; E116 replaced with H, K, R, A, G, I, L, S, T, M, V, N, Q, F, W, Y, P, or C; P117 replaced with D, E, H, K, R, A, G, I, L, S, T, M, V, N, Q, F, W, Y, or C; P118 replaced with D, E, H, K, R, A, G, I, L, S, T, M, V, N, Q, F, W, Y, or C; A119 replaced with D, E, H, K, R, N, Q, F, W, Y, P, or C; P120 replaced with D, E, H, K, R, A, G, I, L, S, T, M, V, N, Q, F, W, Y, or C; G121 replaced with D, E, H, K, R, N, Q, F, W, Y, P, or C; E122 replaced with H, K, R, A, G, I, L, S, T, M, V, N, Q, F, W, Y, P, or C; G123 replaced with D, E, H, K, R, N, Q, F, W, Y, P, or C; N124 replaced with D, E, H, K, R, A, G, I, L, S, T, M, V, F, W, Y, P, or C; S125 replaced with D, E, H, K, R, N, Q, F, W, Y, P, or C; S126 replaced with D, E, H, K, R, N, Q, F, W, Y, P, or C; Q127 replaced with D, E, H, K, R, A, G, I, L, S, T, M, V, F, W, Y, P, or C; N128 replaced with D, E, H, K, R, A, G, I, L, S, T, M, V, F, W, Y, P, or C; S129 replaced with D, E, H, K, R, N, Q, F, W, Y, P, or C; R130 replaced with D, E, A, G, I, L, S, T, M, V, N, Q, F, W, Y, P, or C; N131 replaced with D, E, H, K, R, A, G, I, L, S, T, M, V, F, W, Y, P, or C; K132 replaced with D, E, A, G, I, L, S, T, M, V, N, Q, F, W, Y, P, or C; R133 replaced with D, E, A, G, I, L, S, T, M, V, N, Q, F, W, Y, P, or C; A134 replaced with D, E, H, K, R, N, Q, F, W, Y, P, or C; V135 replaced with D, E, H, K, R, N, Q, F, W, Y, P, or C; Q136 replaced with D, E, H, K, R, A, G, I, L, S, T, M, V, F, W, Y, P, or C; G137 replaced with D, E, H, K, R, N, Q, F, W, Y, P, or C; P138 replaced with D, E, H, K, R, A, G, I, L, S, T, M, V, N, Q, F, W, Y, or C; E139 replaced with H, K, R, A, G, I, L, S, T, M, V, N, Q, F, W, Y, P, or C; E140 replaced with H, K, R, A, G, I, L, S, T, M, V, N, Q, F, W, Y, P, or C; T141 replaced with D, E, H, K, R, N, Q, F, W, Y, P, or C; G142 replaced with D, E, H, K, R, N, Q, F, W, Y, P, or C; S143 replaced with D, E, H, K, R, N, Q, F, W, Y, P, or C; Y144 replaced with D, E, H, K, R, N, Q, A, G, I, L, S, T, M, V, P, or C; T145 replaced with D, E, H, K, R, N, Q, F, W, Y, P, or C; F146 replaced with D, E, H, K, R, N, Q, A, G, I, L, S, T, M, V, P, or C; V147 replaced with D, E, H, K, R, N, Q, F, W, Y, P, or C; P148 replaced with D, E, H, K, R, A, G, I, L, S, T, M, V, N, Q, F, W, Y, or C; W149 replaced with D, E, H, K, R, N, Q, A, G, I, L, S, T, M, V, P, or C; L150 replaced with D, E, H, K, R, N, Q, F, W, Y, P, or C; L151 replaced with D, E, H, K, R, N, Q, F, W, Y, P, or C; S152 replaced with D, E, H, K, R, N, Q, F, W, Y, P, or C; F153 replaced with D, E, H, K, R, N, Q, A, G, I, L, S, T, M, V, P, or C; K154 replaced with D, E, A, G, I, L, S, T, M, V, N, Q, F, W, Y, P, or C; R155 replaced with D, E, A, G, I, L, S, T, M, V, N, Q, F, W, Y, P, or C; G156 replaced with D, E, H, K, R, N, Q, F, W, Y, P, or C; S157 replaced with D, E, H, K, R, N, Q, F, W, Y, P, or C; A158 replaced with D, E, H, K, R, N, Q, F, W, Y, P, or C; L159 replaced with D, E, H, K, R, N, Q, F, W, Y, P, or C; E160 replaced with H, K, R, A, G, I, L, S, T, M, V, N, Q, F, W, Y, P, or C; E161 replaced with H, K, R, A, G, I, L, S, T, M, V, N, Q, F, W, Y, P, or C; K162 replaced with D, E, A, G, I, L, S, T, M, V, N, Q, F, W, Y, P, or C; E163 replaced with H, K, R, A, G, I, L, S, T, M, V, N, Q, F, W, Y, P, or C; N164 replaced with D, E, H, K, R, A, G, I, L, S, T, M, V, F, W, Y, P, or C; K165 replaced with D, E, A, G, I, L, S, T, M, V, N, Q, F, W, Y, P, or C; I166 replaced with D, E, H, K, R, N, Q, F, W, Y, P, or C; L167 replaced with D, E, H, K, R, N, Q, F, W, Y, P, or C; V168 replaced with D, E, H, K, R, N, Q, F, W, Y, P, or C; K169 replaced with D, E, A, G, I, L, S, T, M, V, N, Q, F, W, Y, P, or C; E170 replaced with H, K, R, A, G, I, L, S, T, M, V, N, Q, F, W, Y, P, or C; T171 replaced with D, E, H, K, R, N, Q, F, W, Y, P, or C; G172 replaced with D, E, H, K, R, N, Q, F, W, Y, P, or C; Y173 replaced with D, E, H, K, R, N, Q, A, G, I, L, S, T, M, V, P, or C; F174 replaced with D, E, H, K, R, N, Q, A, G, I, L, S, T, M, V, P, or C; F175 replaced with D, E, H, K, R, N, Q, A, G, I, L, S, T, M, V, P, or C; I176 replaced with D, E, H, K, R, N, Q, F, W, Y, P, or C; Y177 replaced with D, E, H, K, R, N, Q, A, G, I, L, S, T, M, V, P, or C; G178 replaced with D, E, H, K, R, N, Q, F, W, Y, P, or C; Q179 replaced with D, E, H, K, R, A, G, I, L, S, T, M, V, F, W, Y, P, or C; V180 replaced with D, E, H, K, R, N, Q, F, W, Y, P, or C; L181 replaced with D, E, H, K, R, N, Q, F, W, Y, P, or C; Y182 replaced with D, E, H, K, R, N, Q, A, G, I, L, S, T, M, V, P, or C; T183 replaced with D, E, H, K, R, N, Q, F, W, Y, P, or C; D184 replaced with H, K, R, A, G, I, L, S, T, M, V, N, Q, F, W, Y, P, or C; K185 replaced with D, E, A, G, I, L, S, T, M, V, N, Q, F, W, Y, P, or C; T186 replaced with D, E, H, K, R, N, Q, F, W, Y, P, or C; Y187 replaced with D, E, H, K, R, N, Q, A, G, I, L, S, T, M, V, P, or C; A188 replaced with D, E, H, K, R, N, Q, F, W, Y, P, or C; M189 replaced with D, E, H, K, R, N, Q, F, W, Y, P, or C; G190 replaced with D, E, H, K, R, N, Q, F, W, Y, P, or C; H191 replaced with D, E, A, G, I, L, S, T, M, V, N, Q, F, W, Y, P, or C; L192 replaced with D, E, H, K, R, N, Q, F, W, Y, P, or C; I193 replaced with D, E, H, K, R, N, Q, F, W, Y, P, or C; Q194 replaced with D, E, H, K, R, A, G, I, L, S, T, M, V, F, W, Y, P, or C; R195 replaced with D, E, A, G, I, L, S, T, M, V, N, Q, F, W, Y, P, or C; K196 replaced with D, E, A, G, I, L, S, T, M, V, N, Q, F, W, Y, P, or C; K197 replaced with D, E, A, G, I, L, S, T, M, V, N, Q, F, W, Y, P, or C; V198 replaced with D, E, H, K, R, N, Q, F, W, Y, P, or C; H199 replaced with D, E, A, G, I, L, S, T, M, V, N, Q, F, W, Y, P, or C; V200 replaced with D, E, H, K, R, N, Q, F, W, Y, P, or C; F201 replaced with D, E, H, K, R, N, Q, A, G, I, L, S, T, M, V, P, or C; G202 replaced with D, E, H, K, R, N, Q, F, W, Y, P, or C; D203 replaced with H, K, R, A, G, I, L, S, T, M, V, N, Q, F, W, Y, P, or C; E204 replaced with H, K, R, A, G, I, L, S, T, M, V, N, Q, F, W, Y, P, or C; L205 replaced with D, E, H, K, R, N, Q, F, W, Y, P, or C; S206 replaced with D, E, H, K, R, N, Q, F, W, Y, P, or C; L207 replaced with D, E, H, K, R, N, Q, F, W, Y, P, or C; V208 replaced with D, E, H, K, R, N, Q, F, W, Y, P, or C; T209 replaced with D, E, H, K, R, N, Q, F, W, Y, P, or C; L210 replaced with D, E, H, K, R, N, Q, F, W, Y, P, or C; F211 replaced with D, E, H, K, R, N, Q, A, G, I, L, S, T, M, V, P, or C; R212 replaced with D, E, A, G, I, L, S, T, M, V, N, Q, F, W, Y, P, or C; C213 replaced with D, E, H, K, R, A, G, I, L, S, T, M, V, N, Q, F, W, Y, or P; I214 replaced with D, E, H, K, R, N, Q, F, W, Y, P, or C; Q215 replaced with D, E, H, K, R, A, G, I, L, S, T, M, V, F, W, Y, P, or C; N216 replaced with D, E, H, K, R, A, G, I, L, S, T, M, V, F, W, Y, P, or C; M217 replaced with D, E, H, K, R, N, Q, F, W, Y, P, or C; P218 replaced with D, E, H, K, R, A, G, I, L, S, T, M, V, N, Q, F, W, Y, or C; E219 replaced with H, K, R, A, G, I, L, S, T, M, V, N, Q, F, W, Y, P, or C; T220 replaced with D, E, H, K, R, N, Q, F, W, Y, P, or C; L221 replaced with D, E, H, K, R, N, Q, F, W, Y, P, or C; P222 replaced with D, E, H, K, R, A, G, I, L, S, T, M, V, N, Q, F, W, Y, or C; N223 replaced with D, E, H, K, R, A, G, I, L, S, T, M, V, F, W, Y, P, or C; N224 replaced with D, E, H, K, R, A, G, I, L, S, T, M, V, F, W, Y, P, or C; S225 replaced with D, E, H, K, R, N, Q, F, W, Y, P, or C; C226 replaced with D, E, H, K, R, A, G, I, L, S, T, M, V, N, Q, F, W, Y, or P; Y227 replaced with D, E, H, K, R, N, Q, A, G, I, L, S, T, M, V, P, or C; S228 replaced with D, E, H, K, R, N, Q, F, W, Y, P, or C; A229 replaced with D, E, H, K, R, N, Q, F, W, Y, P, or C; G230 replaced with D, E, H, K, R, N, Q, F, W, Y, P, or C; I231 replaced with D, E, H, K, R, N, Q, F, W, Y, P, or C; A232 replaced with D, E, H, K, R, N, Q, F, W, Y, P, or C; K233 replaced with D, E, A, G, I, L, S, T, M, V, N, Q, F, W, Y, P, or C; L234 replaced with D, E, H, K, R, N, Q, F, W, Y, P, or C; E235 replaced with H, K, R, A, G, I, L, S, T, M, V, N, Q, F, W, Y, P, or C; E236 replaced with H, K, R, A, G, I, L, S, T, M, V, N, Q, F, W, Y, P, or C; G237 replaced with D, E, H, K, R, N, Q, F, W, Y, P, or C; D238 replaced with H, K, R, A, G, I, L, S, T, M, V, N, Q, F, W, Y, P, or C; E239 replaced with H, K, R, A, G, I, L, S, T, M, V, N, Q, F, W, Y, P, or C; L240 replaced with D, E, H, K, R, N, Q, F, W, Y, P, or C; Q241 replaced with D, E, H, K, R, A, G, I, L, S, T, M, V, F, W, Y, P, or C; L242 replaced with D, E, H, K, R, N, Q, F, W, Y, P, or C; A243 replaced with D, E, H, K, R, N, Q, F, W, Y, P, or C; I244 replaced with D, E, H, K, R, N, Q, F, W, Y, P, or C; P245 replaced with D, E, H, K, R, A, G, I, L, S, T, M, V, N, Q, F, W, Y, or C; R246 replaced with D, E, A, G, I, L, S, T, M, V, N, Q, F, W, Y, P, or C; E247 replaced with H, K, R, A, G, I, L, S, T, M, V, N, Q, F, W, Y, P, or C; N248 replaced with D, E, H, K, R, A, G, I, L, S, T, M, V, F, W, Y, P, or C; A249 replaced with D, E, H, K, R, N, Q, F, W, Y, P, or C; Q250 replaced with D, E, H, K, R, A, G, I, L, S, T, M, V, F, W, Y, P, or C; I251 replaced with D, E, H, K, R, N, Q, F, W, Y, P, or C; S252 replaced with D, E, H, K, R, N, Q, F, W, Y, P, or C; L253 replaced with D, E, H, K, R, N, Q, F, W, Y, P, or C; D254 replaced with H, K, R, A, G, I, L, S, T, M, V, N, Q, F, W, Y, P, or C; G255 replaced with D, E, H, K, R, N, Q, F, W, Y, P, or C; D256 replaced with H, K, R, A, G, I, L, S, T, M, V, N, Q, F, W, Y, P, or C; V257 replaced with D, E, H, K, R, N, Q, F, W, Y, P, or C; T258 replaced with D, E, H, K, R, N, Q, F, W, Y, P, or C; F259 replaced with D, E, H, K, R, N, Q, A, G, I, L, S, T, M, V, P, or C; F260 replaced with D, E, H, K, R, N, Q, A, G, I, L, S, T, M, V, P, or C; G261 replaced with D, E, H, K, R, N, Q, F, W, Y, P, or C; A262 replaced with D, E, H, K, R, N, Q, F, W, Y, P, or C; L263 replaced with D, E, H, K, R, N, Q, F, W, Y, P, or C; K264 replaced with D, E, A, G, I, L, S, T, M, V, N, Q, F, W, Y, P, or C; L265 replaced with D, E, H, K, R, N, Q, F, W, Y, P, or C; and/or L266 replaced with D, E, H, K, R, N, Q, F, W, Y, P, or C.

In another embodiment, site directed changes at the amino acid level of B Lymphocyte Stimulator can be made by replacing a particular amino acid with a non-conservative substitution. Antibodies of the present invention may bind B Lymphocyte Stimulator amino acid sequences containing non-conservative substitution mutations of the polypeptide of any one of SEQ ID NOS:3230–3237.

In an additional embodiment, antibodies of the present invention bind B Lymphocyte Stimulator polypeptides comprising, or alternatively consisting of, a B Lymphocyte Stimulator amino acid sequence in which more than one amino acid (e.g., 2, 3, 4, 5, 6, 7, 8, 9, 10, 15, 20, 30 and 50) is replaced with the substituted amino acids as described above (either conservative or nonconservative).

Replacement of amino acids can also change the selectivity of the binding of a ligand to cell surface receptors. For example, Ostade et al., *Nature* 361:266–268 (1993) describes certain mutations resulting in selective binding of TNF-alpha to only one of the two known types of TNF receptors. Since B Lymphocyte Stimulator is a member of the TNF polypeptide family, mutations similar to those in TNF-alpha are likely to have similar effects in B Lymphocyte Stimulator polypeptides.

Sites that are critical for ligand-receptor binding can also be determined by structural analysis such as crystallization, nuclear magnetic resonance or photoaffinity labeling (Smith et al., *J. Mol. Biol.* 224:899–904 (1992) and de Vos et al. *Science* 255:306–312 (1992)).

Since B Lymphocyte Stimulator is a member of the TNF-related protein family, mutations may be made in sequences encoding amino acids in the TNF conserved domain, e.g., in positions Gly-191 through Leu-284 of SEQ ID NO:3228 or in positions Gly-172 through Leu-265 of SEQ ID NO:3229, may modulate rather than completely eliminate functional activities (e.g., biological activities) of B Lymphocyte Stimulator polypeptides or fragments or variants thereof. Accordingly, antibodies of the present invention may bind B Lymphocyte Stimulator polypeptides that have mutations in the TNF conserved domain. In preferred embodiments, antibodies of the present invention may bind B Lymphocyte Stimulator polypeptides that have mutations in the TNF conserved domain and act as antagonists of B Lymphocyte Stimulator. In other preferred embodiments, antibodies of the present invention may bind B Lymphocyte Stimulator polypeptides that have mutations in the TNF conserved domain and act as agonists of B Lymphocyte Stimulator.

Recombinant DNA technology known to those skilled in the art (see, for instance, DNA shuffling supra) can be used to create novel mutant proteins or muteins including single or multiple amino acid substitutions, deletions, additions or fusion proteins. Such modified polypeptides can show, e.g., enhanced activity or increased stability. In addition, they may be purified in higher yields and show better solubility than the corresponding natural polypeptide, at least under certain purification and storage conditions.

Thus, the invention also encompasses antibodies that bind B Lymphocyte Stimulator derivatives and analogs that have one or more amino acid residues deleted, added, or substituted to generate B Lymphocyte Stimulator polypeptides, e.g., that are better suited for expression, scale up, etc., in the host cells. For example, cysteine residues can be deleted or substituted with another amino acid residue in order to eliminate disulfide bridges; N-linked glycosylation sites can be altered or eliminated to achieve, for example, expression of a homogeneous product that is more easily recovered and purified from yeast hosts which are known to hyperglycosylate N-linked sites. To this end, a variety of amino acid substitutions at one or both of the first or third amino acid positions on any one or more of the glycosylation recognition sequences in the B Lymphocyte Stimulator polypeptides of the invention, and/or an amino acid deletion at the second position of any one or more such recognition sequences will prevent glycosylation of the B Lymphocyte Stimulator at the modified tripeptide sequence (see, e.g., Miyajimo et al., EMBO J 5(6):1193–1197). By way of non-limiting example, mutation of the serine at position 244 to alanine either singly or in combination with mutation of the asparagine at position 242 to glutamine abolishes glycosylation of the mature soluble form of B Lymphocyte Stimulator (e.g., amino acids 134–285 of SEQ ID NO:3228) when expressed in the yeast *Pichea pastoris*. A mutant B Lymphocyte Stimulator polypeptide in which only the asparagine at position 242 is mutated to glutamine, is still gycosylated when expressed in *Pichea pastoris*. In this mutant, the glycosylation event may be due to the activation or unmasking of an O-linked glyscosylation site at serine 244. Similar mutations affecting glycosylation could also be made in the B Lymphocyte Stimulator polypeptide of SEQ ID NO:3229, i.e., aspargine-223 to glutamine and/or serine-224 to alanine of SEQ ID NO:3229. Additionally, one or more of the amino acid residues of the polypeptides of the invention (e.g., arginine and lysine residues) may be deleted or substituted with another residue to eliminate undesired processing by proteases such as, for example, furins or kexins. One possible result of such a mutation is that B Lymphocyte Stimulator polypeptide of the invention is not cleaved and released from the cell surface. Accordingly, antibodies of the invention may bind B Lymphocyte Stimulator derivatives and analogs that have one or more amino acid residues deleted, added, or substituted. In other embodiments, antibodies of the invention may bind B Lymphocyte Stimulator derivatives, variants or analogs that are unable to be cleaved from the cell surface.

In a specific embodiment, antibodies of the invention bind B Lymphocyte Stimulator polypeptides in which Lys-132 and/or Arg-133 of the B Lymphocyte Stimulator sequence shown in SEQ ID NO:3228 is mutated to another amino acid residue, or deleted altogether, to prevent or diminish release of the soluble form of B Lymphocyte Stimulator from cells expressing B Lymphocyte Stimulator. In a more specific embodiment, antibodies of the invention bind B Lymphocyte Stimulator polypeptides in which Lys-132 of the B Lymphocyte Stimulator sequence shown in SEQ ID NO:3228 is mutated to Ala-132. In another, nonexclusive specific embodiment, antibodies of the invention bind B Lymphocyte Stimulator polypeptides in which Arg-133 of the B Lymphocyte Stimulator sequence shown in SEQ ID NO:3228 is mutated to Ala-133. These mutated proteins, and/or have uses such as, for example, in ex vivo therapy or gene therapy, to engineer cells expressing a B Lymphocyte Stimulator polypeptide that is retained on the surface of the engineered cells.

In a specific embodiment, antibodies of the invention bind B Lymphocyte Stimulator polypeptides in which Cys-146 of the B Lymphocyte Stimulator sequence shown in SEQ ID NO:3228 is mutated to another amino acid residue, or deleted altogether, for example, to aid preventing or diminishing oligomerization of the mutant B Lymphocyte Stimulator polypeptide when expressed in an expression system. In a specific embodiment, antibodies of the invention bind B Lymphocyte Stimulator polypeptides in which Cys-146 is replaced with a serine amino acid residue.

In another specific embodiment, antibodies of the invention bind B Lymphocyte Stimulator polypeptides in which Cys-232 of the B Lymphocyte Stimulator sequence shown in SEQ ID NO:3228 is mutated to another amino acid residue, or deleted altogether, for example, to aid preventing or diminishing oligomerization of the mutant B Lymphocyte Stimulator polypeptide when expressed in an expression system. In a specific embodiment, antibodies of the invention bind B Lymphocyte Stimulator polypeptides in which Cys-232 is replaced with a serine amino acid residue. Polypeptides encoding these polypeptides are also encompassed by the invention.

In yet another specific embodiment, antibodies of the invention bind B Lymphocyte Stimulator polypeptides in which Cys-245 of the B Lymphocyte Stimulator sequence shown in SEQ ID NO:3228 is mutated to another amino acid residue, or deleted altogether, for example, to aid preventing or diminishing oligomerization of the mutant B Lymphocyte Stimulator polypeptide when expressed in an expression system. In a specific embodiment, antibodies of the invention bind B Lymphocyte Stimulator polypeptides in which Cys-245 is replaced with a serine amino acid residue. Polypeptides encoding these polypeptides are also encompassed by the invention.

The polypeptides of the present invention are preferably provided in an isolated form, and preferably are substantially purified. A recombinantly produced version of the B Lymphocyte Stimulator polypeptides can be substantially purified by the one-step method described in Smith and Johnson, *Gene* 67:31–40 (1988).

The antibodies of the present invention bind B Lymphocyte Stimulator polypeptides including the complete polypeptide encoded by the deposited cDNA (ATCC™ Deposit No. 97768) including the intracellular, transmembrane and extracellular domains of the polypeptide encoded by the deposited cDNA, the mature soluble polypeptide encoded by the deposited cDNA, the extracellular domain minus the intracellular and transmembrane domains of the protein, the complete polypeptide of SEQ ID NO:3228, the mature soluble polypeptide of SEQ ID NO:3228, e.g., amino acids 134–285 of SEQ ID NO:3228, the extracellular domain of SEQ ID NO:3228, amino acid residues 73–285 of SEQ ID NO:3228 minus the intracellular and transmembrane domains, as well as polypeptides which have at least 80%, 85%, 90% similarity, more preferably at least 95% similarity, and still more preferably at least 96%, 97%, 98% or 99% similarity to those described above. Polynucleotides encoding these polypeptides are also encompassed by the invention.

The antibodies of the present invention bind B Lymphocyte Stimulator polypeptides including the complete polypeptide encoded by the deposited cDNA including the intracellular, transmembrane and extracellular domains of the polypeptide encoded by the deposited cDNA (ATCC™ Deposit No. 203518), the mature soluble polypeptide encoded by the deposited cDNA, the extracellular domain minus the intracellular and transmembrane domains of the protein, the complete polypeptide of SEQ ID NO:3229, the mature soluble of SEQ ID NO:3229, e.g., amino acid residues 134–266 of SEQ ID NO:3229, the extracellular domain of SEQ ID NO:3229, e.g., amino acid residues 73–266 of SEQ ID NO:3229 minus the intracellular and transmembrane domains, as well as polypeptides which have at least 80%, 85%, 90% similarity, more preferably at least 95% similarity, and still more preferably at least 96%, 97%, 98% or 99% similarity to those described above. Polynucleotides encoding these polypeptides are also encompassed by the invention.

Further antibodies of the present invention bind polypeptides including polypeptides at least 80%, or at least 85% identical, more preferably at least 90% or 95% identical, still more preferably at least 96%, 97%, 98% or 99% identical to the polypeptide encoded by the deposited cDNA (ATCC™ Deposit No. 97768) or to the polypeptide of SEQ ID NO:3228, and also include antibodies that bind portions of such polypeptides with at least 30 amino acids and more preferably at least 50 amino acids.

Further antibodies of the present invention bind polypeptides including polypeptides at least 80%, or at least 85% identical, more preferably at least 90% or 95% identical, still more preferably at least 96%, 97%, 98% or 99% identical to the polypeptide encoded by the deposited cDNA (ATCC™ Deposit No. 203518) or to the polypeptide of SEQ ID NO:3229, and also include antibodies that bind portions of such polypeptides with at least 30 amino acids and more preferably at least 50 amino acids. Polynucleotides encoding these polypeptides are also encompassed by the invention.

By "% similarity" for two polypeptides is intended a similarity score produced by comparing the amino acid sequences of the two polypeptides using the Bestfit program (Wisconsin Sequence Analysis Package, Version 8 for Unix, Genetics Computer Group, University Research Park, 575 Science Drive, Madison, Wis. 53711) and the default settings for determining similarity. Bestfit uses the local homology algorithm of Smith and Waterman (Advances in Applied Mathematics 2:482–489, 1981) to find the best segment of similarity between two sequences.

By a polypeptide having an amino acid sequence at least, for example, 95% "identical" to a reference amino acid sequence of a B Lymphocyte Stimulator polypeptide is intended that the amino acid sequence of the polypeptide is identical to the reference sequence except that the polypeptide sequence may include up to five amino acid alterations per each 100 amino acids of the reference amino acid of the B Lymphocyte Stimulator polypeptide. In other words, to obtain a polypeptide having an amino acid sequence at least 95% identical to a reference amino acid sequence, up to 5% of the amino acid residues in the reference sequence may be deleted or substituted with another amino acid, or a number of amino acids up to 5% of the total amino acid residues in the reference sequence may be inserted into the reference sequence. These alterations of the reference sequence may occur at the amino or carboxy terminal positions of the reference amino acid sequence or anywhere between those terminal positions, interspersed either individually among residues in the reference sequence or in one or more contiguous groups within the reference sequence.

As a practical matter, whether any particular polypeptide is at least 80%, 85%, 90%, 95%, 96%, 97%, 98% or 99% identical to, for instance, the amino acid sequence of SEQ ID NO:3228, the amino acid sequence encoded by the deposited cDNA clone HNEDU15 (ATCC™ Accession No. 97768), or fragments thereof, or, for instance, to the amino acid sequence of SEQ ID NO:3229, the amino acid sequence encoded by the deposited cDNA clone HDPMC52 (ATCC™ Accession No. 203518), or fragments thereof, can be determined conventionally using known computer programs such the Bestfit program (Wisconsin Sequence Analysis Package, Version 8 for Unix, Genetics Computer Group, University Research Park, 575 Science Drive, Madison, Wis. 53711). When using Bestfit or any other sequence alignment program to determine whether a particular sequence is, for instance, 95% identical to a reference sequence according to the present invention, the parameters are set, of course, such that the percentage of identity is calculated over the full length of the reference amino acid sequence and that gaps in homology of up to 5% of the total number of amino acid residues in the reference sequence are allowed.

In a specific embodiment, the identity between a reference (query) sequence (a sequence of the present invention) and a subject sequence, also referred to as a global sequence alignment, is determined using the FASTDB computer program based on the algorithm of Brutlag et al. (Comp. App. Biosci. 6:237–245 (1990)). Preferred parameters used in a FASTDB amino acid alignment are: Matrix=PAM 0, k-tuple=2, Mismatch Penalty=1, Joining Penalty=20, Randomization Group Length=0, Cutoff Score=1, Window Size=sequence length, Gap Penalty=5, Gap Size Penalty=0.05, Window Size=500 or the length of the subject amino acid sequence, whichever is shorter. According to this embodiment, if the subject sequence is shorter than the query sequence due to N- or C-terminal deletions, not because of internal deletions, a manual correction is made to the results to take into consideration the fact that the FASTDB program does not account for N- and C-terminal truncations of the subject sequence when calculating global percent identity. For subject sequences truncated at the N- and C-termini, relative to the query sequence, the percent identity is corrected by calculating the number of residues of the query sequence that are N- and C-terminal of the subject sequence, which are not matched/aligned with a corresponding subject residue, as a percent of the total bases of the query sequence. A determination of whether a residue is matched/aligned is determined by results of the FASTDB sequence alignment. This percentage is then subtracted from the percent identity, calculated by the above FASTDB program using the specified parameters, to arrive at a final percent identity score. This final percent identity score is what is used for the purposes of this embodiment. Only residues to the N- and C-termini of the subject sequence, which are not matched/aligned with the query sequence, are considered for the purposes of manually adjusting the percent identity score. That is, only query residue positions outside the farthest N- and C-terminal residues of the subject sequence. For example, a 90 amino acid residue subject sequence is aligned with a 100 residue query sequence to determine percent identity. The deletion occurs at the N-terminus of the subject sequence and therefore, the FASTDB alignment does not show a matching/alignment of the first 10 residues at the N-terminus. The 10 unpaired residues represent 10% of the sequence (number of residues at the N- and C-termini not matched/total number of residues in the query sequence) so 10% is subtracted from the percent identity score calculated by the FASTDB program. If the remaining 90 residues were perfectly matched the final percent identity would be 90%. In another example, a 90 residue subject sequence is compared with a 100 residue query sequence. This time the deletions are internal deletions so there are no residues at the N- or C-termini of the subject sequence which are not matched/aligned with the query. In this case the percent identity calculated by FASTDB is not manually corrected. Once again, only residue positions outside the N- and C-terminal ends of the subject sequence, as displayed in the FASTDB alignment, which are not matched/aligned with the query sequence are manually corrected for. No other manual corrections are made for the purposes of this embodiment.

Antibodies that Immunospecifically Bind B Lymphocyte Stimulator Polypeptides

The present invention also encompasses antibodies (including molecules comprising, or alternatively consisting of, antibody fragments or variants thereof) that immunospecifically bind to B Lymphocyte Stimulator polypeptides, which antibodies comprise, or alternatively consist of, all or a portion of a heavy and/or light chain variable domain of the scFvs referred to in Table 1.

The present invention also encompasses methods and compositions for detecting, diagnosing and/or prognosing diseases or disorders associated with aberrant B Lymphocyte Stimulator or B Lymphocyte Stimulator receptor expression or inappropriate B Lymphocyte Stimulator or B Lymphocyte Stimulator receptor function in an animal, preferably a mammal, and most preferably a human, comprising using antibodies (including molecules which comprise, or alternatively consist of, antibody fragments or variants thereof) that immunospecifically bind to B Lymphocyte Stimulator. Diseases and disorders which can be detected, diagnosed or prognosed with the antibodies of the invention include, but are not limited to, immune disorders (e.g., lupus, rheumatoid arthritis, multiple sclerosis, myasthenia gravis, Hashimoto's disease, and immunodeficiency syndrome), inflammatory disorders (e.g., asthma, allergic disorders, and rheumatoid arthritis), infectious diseases (e.g., AIDS), and proliferative disorders (e.g., leukemia, carcinoma, and lymphoma).

The present invention further encompasses methods and compositions for preventing, treating or ameliorating diseases or disorders associated with aberrant B Lymphocyte Stimulator or B Lymphocyte Stimulator receptor expression or inappropriate B Lymphocyte Stimulator or B Lymphocyte Stimulator receptor function in an animal, preferably a mammal, and most preferably a human, comprising administering to said animal an effective amount of one or more antibodies (including molecules which comprise, or alternatively consist of, antibody fragments or variants thereof) that immunospecifically bind to B Lymphocyte Stimulator. Diseases and disorders which can be prevented, treated or inhibited by administering an effective amount of one or more antibodies or molecules of the invention include, but are not limited to, immune disorders (e.g., lupus, rheumatoid arthritis, multiple sclerosis, myasthenia gravis, Hashimoto's disease, and immunodeficiency syndrome), inflammatory disorders (e.g., asthma, allergic disorders, and rheumatoid arthritis), infectious diseases (e.g., AIDS), and proliferative disorders (e.g., leukemia, carcinoma, and lymphoma).

Anti-B Lymphocyte Stimulator Antibodies

The antibodies of the present invention were discovered, in part, using phage display technology. Single chain antibody molecules ("scFvs") displayed on the surface of phage particles were screened to identify those scFvs that immunospecifically bind to B Lymphocyte Stimulator, including the membrane-bound form and soluble form of B Lymphocyte Stimulator. The present invention encompasses the scFvs and portions thereof that were identified to immunospecifically bind to B Lymphocyte Stimulator, including scFvs that immunospecifically bind to the soluble form of B Lymphocyte Stimulator, scFvs that immunospecifically bind to the membrane-bound form of B Lymphocyte Stimulator, and scFvs that immunospecifically bind to both the soluble form and membrane-bound form of B Lymphocyte Stimulator. In particular, the present invention encompasses scFvs comprising, or alternatively consisting of, the amino acid sequence of SEQ ID NOS: 1–2128, as referred to in Table 1. Preferably, the scFvs of the present invention comprise, or alternatively consist of, the amino acid sequence of SEQ ID NOS:1–46, 321–329, 834–872, 1563–1595, or 1881–1908. The scFvs include scFvs that bind to soluble B Lymphocyte Stimulator (e.g., scFvs comprising, or alternatively consisting of, an amino acid sequence of SEQ ID NOS: 1563–1880), scFvs that bind to the membrane-bound form of B Lymphocyte Stimulator (e.g., scFvs comprising, or alternatively consisting of, an amino acid sequence of SEQ ID NOS: 1881–2128), and scFvs that bind to both the soluble form and the membrane-bound form of B Lymphocyte Stimulator (e.g., scFvs comprising, or alternatively consisting of, an amino acid sequence of SEQ ID NOS: 1–1562). Molecules comprising, or alternatively consisting of, fragments or variants of these scFvs, that immunospecifically bind to B Lymphocyte Stimulator are also encompassed by the invention, as are nucleic acid molecules encoding these scFvs, molecules, fragments and/or variants.

In one embodiment of the present invention, scFvs that immunospecifically bind to B Lymphocyte Stimulator comprise a polypeptide having the amino acid sequence of any one of the VH domains referred to in Table 1 and/or any one of the VL domains referred to in Table 1. In preferred embodiments, scFvs of the present invention comprise the amino acid sequence of a VH domain and VL domain from the same scFv referred to in Table 1. In alternative embodiments, scFvs of the present invention comprise the amino acid sequence of a VH domain and VL domain from different scFvs referred to in Table 1. In another embodiment, scFvs that immunospecifically bind to B Lymphocyte Stimulator, comprise a polypeptide having the amino acid sequence of any one, two, three, or more of the VH CDRs referred to in Table 1 and/or any one, two, three, or more of the VL CDRs referred to in Table 1. In preferred embodiments, scFvs of the present invention comprise the amino acid sequence of a VH CDR and VL CDR from the same scFv referred to in Table 1. In alternative embodiments, scFvs of the present invention comprise the amino acid sequence of a VH CDR and VL CDR from different scFvs referred to in Table 1. Molecules comprising, or alternatively consisting of, antibody fragments or variants of the scFvs referred to in Table 1 that immunospecifically bind to B Lymphocyte Stimulator are also encompassed by the invention, as are nucleic acid molecules encoding these scFvs, molecules, fragments and/or variants.

(Table 1 can be found at the end of the specification just prior to the claims.)

In another embodiment of the present invention, an scFv that immunospecifically binds to a soluble form of B Lymphocyte Stimulator, comprises, or alternatively consists of, the amino acid sequence of SEQ ID NOS:1563–1880 as referred to in Table 1. In a preferred embodiment, an scFv that immunospecifically binds to a soluble form of B Lymphocyte Stimulator comprises, or alternatively consists of, the amino acid sequence of SEQ ID NOS:1570–1595. In an even more preferred embodiment, an scFv that immunospecifically binds to a soluble form of B Lymphocyte Stimulator comprises, or alternatively consists of, the amino acid sequence of SEQ ID NOS:1563–1569.

In another embodiment of the present invention, an scFv that immunospecifically binds to a membrane-bound form of B Lymphocyte Stimulator comprises, or alternatively consists of, the amino acid sequence of SEQ ID NOS:1881–2128 as referred to in Table 1. In a preferred embodiment, an scFv that immunospecifically binds to a membrane-bound form of B Lymphocyte Stimulator comprises, or alternatively consists of, the amino acid sequence of SEQ ID NOS:1886–1908. In an even more preferred embodiment, an scFv that immunospecifically binds to a membrane-bound form of B Lymphocyte Stimulator comprises, or alternatively consists of, the amino acid sequence of SEQ ID NOS:1881–1885.

In another embodiment of the present invention, an scFv that immunospecifically binds to both the soluble form and membrane-bound form of B Lymphocyte Stimulator comprises, or alternatively consists of, the amino acid sequence of SEQ ID NOS:1–1562 as referred to in Table 1. In a preferred embodiment, an scFv that immunospecifically binds to both the soluble form and membrane-bound form of B Lymphocyte Stimulator comprises, or alternatively consists of, the amino acid sequence of SEQ ID NOS:834–872. In another preferred embodiment, an scFv that immunospecifically binds to both the soluble form and membrane-bound form of B Lymphocyte Stimulator comprises, or alternatively consists of, any one of the amino acids sequences of SEQ ID NOS:1–46 or 321–329. Molecules comprising, or alternatively consisting of, fragments or variants of these scFvs, that immunospecifically bind to the soluble form of B Lymphocyte Stimulator and/or the membrane-bound form of B Lymphocyte Stimulator are also encompassed by the invention, as are nucleic acid molecules encoding these scFvs, molecules, fragments and/or variants.

In another embodiment of the present invention, scFvs that immunospecifically bind to the soluble form of B Lymphocyte Stimulator, comprise a polypeptide having the amino acid sequence of any one of the VH domains contained in SEQ ID NOS:1563–1880 as disclosed in Table 1 and/or any one of the VL domains contained in SEQ ID NOS:1563–1880 as disclosed in Table 1. In preferred embodiments, scFvs of the present invention that immunospecifically bind to the soluble form of B Lymphocyte Stimulator, comprise a polypeptide having the amino acid sequence of a VH CDR and VL CDR from the same scFv referred to in Table 1. In alternative embodiments, scFvs of the present invention that immunospecifically bind to the soluble form of B Lymphocyte Stimulator, comprise a polypeptide having amino acid sequence of a VH CDR and VL CDR from different scFvs referred to in Table 1. In another embodiment, scFvs that immunospecifically bind to the soluble form of B Lymphocyte Stimulator, comprise a polypeptide having the amino acid sequence of any one, two, three, or more of the VH CDRs SEQ ID NOS: 1563–1880 as disclosed in Table 1 and/or any one, two, three, or more of the VL CDRs contained in contained SEQ ID NOS:1563–1880, as disclosed in Table 1. In preferred embodiments, scFvs of the present invention that immunospecifically bind to the soluble form of B Lymphocyte Stimulator, comprise a polypeptide having the amino acid sequence of a VH domain and VL domain from the same scFv referred to in Table 1. In alternative embodiments, scFvs of the present invention that immunospecifically bind to the soluble form of B Lymphocyte Stimulator, comprise a polypeptide having the of the amino acid sequence of a VH domain and VL domain from different scFvs referred to in Table 1. In a preferred embodiment, scFvs that immunospecifically bind to the soluble form of B Lymphocyte Stimulator, comprise a polypeptide having the amino acid sequence of any one of the VH CDR3s contained in SEQ ID NOS:1563–1880 as disclosed in Table 1 and/or any one of the VL CDR3s contained in SEQ ID NOS: 1563–1880 as disclosed in Table 1. In preferred embodiments, scFvs of the present invention that immunospecifically bind to the soluble form of B Lymphocyte Stimulator, comprise a polypeptide having the amino acid sequence of a VH CDR and VL CDR from the same scFv referred to in Table 1. In alternative embodiments, scFvs of the present invention that immunospecifically bind to the soluble form of B Lymphocyte Stimulator, comprise a polypeptide having the amino acid sequence of a VH CDR and VL CDR from different scFvs referred to in Table 1. Molecules comprising, or alternatively consisting of, fragments or variants of these scFvs, that immunospecifically bind to B Lymphocyte Stimulator, preferably the soluble form of B Lymphocyte Stimulator, are also encompassed by the invention, as are nucleic acid molecules encoding these scFvs, molecules, fragments and/or variants.

In another embodiment of the present invention, scFvs that immunospecifically bind to the membrane-bound form of B Lymphocyte Stimulator comprise a polypeptide having the amino acid sequence of any one of the VH domains contained in SEQ ID NOS:1881–2128 as disclosed in Table 1 and/or any one of the VL domains contained in SEQ ID NOS: 1881–2128 as disclosed in Table 1. In preferred embodiments, scFvs of the present invention that immunospecifically bind to the soluble form of B Lymphocyte Stimulator, comprise a polypeptide having the amino acid sequence of a VH CDR and VL CDR from the same scFv referred to in Table 1. In alternative embodiments, scFvs of the present invention that immunospecifically bind to the membrane-bound form of B Lymphocyte Stimulator, comprise a polypeptide having the amino acid sequence of a VH domain and VL domain from different scFvs referred to in Table 1. In another embodiment, scFvs that immunospecifically bind to the membrane-bound form of B Lymphocyte Stimulator, comprise a polypeptide having the amino acid sequence of any one, two, three, or more of the VH CDRs contained in SEQ ID NOS: 1881–2128 as disclosed in Table 1 and/or any one, two, three, or more of the VL CDRs contained in SEQ ID NOS: 1881–2128 as disclosed in Table 1. In preferred embodiments, scFvs of the present invention that immunospecifically bind to the membrane-bound form of B Lymphocyte Stimulator, comprise a polypeptide having the amino acid sequence of a VH domain and VL domain from the same scFv referred to in Table 1. In alternative embodiments, scFvs of the present invention that immunospecifically bind to the membrane-bound form of B Lymphocyte Stimulator, comprise a polypeptide having the amino acid sequence of a VH domain and VL domain from different scFvs referred to in Table 1. In a preferred embodiment, scFvs that immunospecifically bind to the membrane-bound form of B Lymphocyte Stimulator, comprise a polypeptide having the amino acid sequence of any one of the VH CDR3s contained in SEQ ID NOS: 1881–2128 as disclosed in Table 1 and/or any one of the VL CDR3s contained in SEQ ID NOS: 1881–2128 as disclosed in Table 1. In preferred embodiments, scFvs of the present invention that immunospecifically bind to the membrane-bound form of B Lymphocyte Stimulator, comprise a polypeptide having the amino acid sequence of a VH domain and VL domain from the same scFv referred to in Table 1. In alternative embodiments, scFvs of the present invention that immunospecifically bind to the membrane-bound form of B Lymphocyte Stimulator, comprise a polypeptide having the amino acid sequence of a VH CDR and VL CDR from different scFvs referred to in Table 1. Molecules comprising, or alternatively consisting of, fragments or variants of these scFvs, that immunospecifically bind to B Lymphocyte Stimulator, preferably the membrane-bound form of B Lymphocyte Stimulator, are also encompassed by the invention, as are nucleic acid molecules encoding these scFvs, molecules, fragments and/or variants.

In another embodiment of the present invention, scFvs that immunospecifically bind to the soluble form and membrane-bound form of B Lymphocyte Stimulator, comprise a polypeptide having the amino acid sequence of any one of the VH domains contained in SEQ ID NOS:1–1562 as disclosed in Table 1 and/or any one of the VL domains contained in SEQ ID NOS:1–1562 as disclosed in Table 1. In preferred embodiments, scFvs of the present invention that immunospecifically bind to the soluble and membrane-bound forms of B Lymphocyte Stimulator, comprise a polypeptide having the amino acid sequence of a VH domain and VL domain from the same scFv referred to in Table 1. In alternative embodiments, scFvs of the present invention that immunospecifically bind to the soluble form and membrane-bound form of B Lymphocyte Stimulator, comprise a polypeptide having the amino acid sequence of a VH domain and VL domain from different scFvs referred to in Table 1. In another embodiment, scFvs that immunospecifically bind to the soluble form and membrane-bound form of B Lymphocyte Stimulator comprise a polypeptide having the amino acid sequence of any one, two, three, or more of the VH CDRs contained in SEQ ID NOS:1–1562 as disclosed in Table 1 and/or any one, two, three, or more of the VL CDRs contained in SEQ ID NOS:1–1562 as disclosed in Table 1. In preferred embodiments, scFvs of the present invention that immunospecifically bind to the soluble form and membrane-bound form of B Lymphocyte Stimulator, comprise a polypeptide having the amino acid sequence of a VH domain and VL domain from the same scFv referred to in Table 1. In alternative embodiments, scFvs of the present invention that immunospecifically bind to the soluble and membrane-bound forms of B Lymphocyte Stimulator, comprise a polypeptide having the amino acid sequence of a VH domain and VL domain from different scFvs referred to in Table 1. In a preferred embodiment, scFvs that immunospecifically bind to the soluble and membrane-bound forms of B Lymphocyte Stimulator, comprise a polypeptide having the amino acid sequence of any one of the VH CDR3s contained in SEQ ID NOS:1–1562 as disclosed in Table 1 and/or any one of the VL CDR3s contained in SEQ ID NOS:1–1562, as disclosed in Table 1. In preferred embodiments, scFvs of the present invention that immunospecifically bind to the soluble and membrane-bound forms of B Lymphocyte Stimulator, comprise a polypeptide having the amino acid sequence of a VH CDR and VL CDR from the same scFv referred to in Table 1. In alternative embodiments, scFvs of the present invention that immunospecifically bind to the soluble and membrane-bound forms of B Lymphocyte Stimulator, comprise a polypeptide having the amino acid sequence of a VH CDR and VL CDR from different scFvs referred to in Table 1. Molecules comprising, or alternatively consisting of, fragments or variants of these scFvs or molecules, that immunospecifically bind to B Lymphocyte Stimulator, preferably the soluble and membrane-bound forms of B Lymphocyte Stimulator, are also encompassed by the invention, as are nucleic acid molecules encoding these scFvs, molecules, fragments and/or variants.

The present invention provides antibodies (including molecules comprising, or alternatively consisting of, antibody fragments or variants thereof) that immunospecifically bind to a polypeptide or a polypeptide fragment of B Lymphocyte Stimulator. In particular, the invention provides antibodies corresponding to the scFvs referred to in Table 1, such scFvs may routinely be "converted" to immunoglobulin molecules by inserting, for example, the nucleotide sequences encoding the VH and/or VL domains of the scFv into an expression vector containing the constant domain sequences and engineered to direct the expression of the immunoglobulin molecule, as described in more detail in Example 20, infra.

In one embodiment, the invention provides antibodies (including molecules comprising, or alternatively consisting of, antibody fragments or variants thereof) wherein said antibodies comprise, or alternatively consist of, a polypeptide having an amino acid sequence of any one of the VH domains contained in the sequences referred to in Table 1. The present invention also provides antibodies that immunospecifically bind to a polypeptide, or polypeptide fragment of B Lymphocyte Stimulator, wherein said antibodies comprise, or alternatively consist of, a polypeptide having an amino acid sequence of any one, two, three, or more of the VH CDRs contained in the sequences referred to in Table 1. Molecules comprising, or alternatively consisting of, these antibodies, or antibody fragments or variants thereof, that immunospecifically bind to B Lymphocyte Stimulator or a B Lymphocyte Stimulator fragment are also encompassed by the invention, as are nucleic acid molecules encoding these antibodies, molecules, fragments and/or variants.

In one embodiment of the present invention, antibodies (including molecules comprising, or alternatively consisting of, antibody fragments or variants thereof) that immunospecifically bind B Lymphocyte Stimulator, comprise, or alternatively consist of, a polypeptide having the amino acid sequence of a VH CDR referred to in Table 1. In particular, the invention provides antibodies that immunospecifically bind B Lymphocyte Stimulator, comprising, or alternatively consisting of, a polypeptide having the amino acid sequence of a VH CDR1 contained in SEQ ID NOS:1–46, 321–329, 1563–1569, or 1881–1885 as disclosed in Table 1. In another embodiment, antibodies that immunospecifically bind B Lymphocyte Stimulator, comprise, or alternatively consist of, a polypeptide having the amino acid sequence of a VH CDR2 contained in SEQ ID NOS:1–46, 321–329, 1563–1569, or 1881–1885 as disclosed in Table 1. In a preferred embodiment, antibodies that immunospecifically bind B Lymphocyte Stimulator, comprise, or alternatively consist of a polypeptide having the amino acid sequence of a VH CDR3 contained in SEQ ID NOS:1–46, 321–329, 1563–1569, or 1881–1885 as disclosed in Table 1. In yet another embodiment, antibodies that immunospecifically bind B Lymphocyte Stimulator, comprise, or alternatively consist of, a polypeptide having the amino acid sequence of a VH CDR1 contained in SEQ ID NOS:834–872, 1570–1595, or 1886–1908 as disclosed in Table 1; a VH CDR2 contained in SEQ ID NOS: SEQ ID NOS: SEQ ID NOS:834–872, 1570–1595, or 1886–1908; and/or a VH CDR3 contained in SEQ ID NOS: SEQ ID NOS:834–872, 1570–1595, or 1886–1908 as disclosed in Table 1. Preferably, antibodies of the invention comprise, or alternatively consist of, VH CDRs that are derived from the same scFv as disclosed in Table 1. Molecules comprising, or alternatively consisting of, fragments or variants of these antibodies that immunospecifically bind to B Lymphocyte Stimulator are also encompassed by the invention, as are nucleic acid molecules encoding these antibodies, molecules, fragments or variants.

The present invention provides antibodies (including molecules comprising, or alternatively consisting of, antibody fragments or variants) that immunospecifically bind to a polypeptide, or polypeptide fragment of B Lymphocyte Stimulator. In particular, the invention provides antibodies wherein said antibodies comprise, or alternatively consist of, a VL domain having an amino acid sequence of any one of the VL domains referred to in Table 1. The present invention also provides antibodies that immunospecifically bind to a polypeptide or polypeptide fragment of B Lymphocyte Stimulator, wherein said antibodies comprise, or alternatively consist of, a VL CDR having an amino acid sequence of any one, two, three, or more of the VL CDRs contained in the sequences referred to in Table 1. Molecules comprising, or alternatively consisting of, fragments or variants of these antibodies that immunospecifically bind to B Lymphocyte Stimulator are also encompassed by the invention, as are nucleic acid molecules encoding these antibodies, molecules, fragments or variants.

In one embodiment of the present invention, antibodies (including molecules comprising, or alternatively consisting of, antibody fragments or variants thereof) that immunospecifically bind B Lymphocyte Stimulator, comprise, or alternatively consist of, a polypeptide having the amino acid sequence of a VL CDR referred to in Table 1. In particular, the invention provides antibodies that immunospecifically bind B Lymphocyte Stimulator, comprising, or alternatively consisting of, a polypeptide having the amino acid sequence of a VL CDR1 contained in SEQ ID NOS:1–46, 321–329, 1563–1569, or 1881–1885 as disclosed in Table 1. In another embodiment, antibodies that immunospecifically bind B Lymphocyte Stimulator comprise, or alternatively consist of, a polypeptide having the amino acid sequence of a VL CDR2 contained in SEQ ID NOS:1–46, 321–329, 1563–1569, or 1881–1885 as disclosed in Table 1. In a preferred embodiment, antibodies comprise, or alternatively consist of, a polypeptide having the amino acid sequence of a VL CDR3 contained in SEQ ID NOS: in SEQ ID NOS: 1–46, 321–329, 1563–1569, or 1881–1885 disclosed in Table 1. In yet another embodiment, antibodies that immunospecifically bind B Lymphocyte Stimulator comprise, or alternatively consist of: a polypeptide having the amino acid sequence of a VL CDR1 contained in SEQ ID NOS: 834–872, 1570–1595, or 1886–1908 as disclosed in Table 1; a VL CDR2 SEQ ID NOS:834–872, 1570–1595, or 1886–1908 as disclosed in Table 1; and a VL CDR3 contained SEQ ID NOS:834–872, 1570–1595, or 1886–1908 as disclosed in Table 1. Preferably, antibodies of the invention comprise, or alternatively consist of, VL CDRs that are derived from the same scFv as disclosed in Table 1. Molecules comprising, or alternatively consisting of, fragments or variants of these antibodies, that immunospecifically bind to B Lymphocyte Stimulator are also encompassed by the invention, as are nucleic acid molecules encoding these antibodies, molecules, fragments or variants.

The present invention also provides antibodies (including molecules comprising, or alternatively consisting of, antibody fragments or variants thereof) that immunospecifically bind to a polypeptide or a polypeptide fragment of B Lymphocyte Stimulator, wherein said antibodies comprise, or alternatively consist of, a VH domain of one of the scFvs referred to in Table 1 combined with a VL domain of one of the scFvs referred to in Table 1, or other VL domain. The present invention further provides antibodies (including molecules comprise, or alternatively consist of, antibody fragments or variants thereof) that immunospecifically bind to a polypeptide or a polypeptide fragment of B Lymphocyte Stimulator, wherein said antibodies comprise, or alternatively consist of, a VL domain of one of the scFvs referred to in Table 1 combined with a VH domain of one of the scFvs referred to in Table 1, or other VH domain. In a preferred embodiment, antibodies that immunospecifically bind to a polypeptide or a polypeptide fragment of B Lymphocyte Stimulator, comprise, or alternatively consist of, a polypeptide having the amino acid sequence of a VH domain contained SEQ ID NOS:1–46, 321–329, 834–872, 1563–1595, or 1881–1908 as disclosed in Table 1 and a VL domain contained in contained SEQ ID NOS:1–46, 321–329, 834–872, 1563–1595, or 1881–1908 as disclosed in Table 1. In a further preferred embodiment, the antibodies of the invention comprise, or alternatively consist of, a VH and a VL domain from the same scFv as disclosed in Table 1. Molecules comprising, or alternatively consisting of, fragments or variants of these antibodies, that immunospecifically bind to B Lymphocyte Stimulator are also encompassed by the invention, as are nucleic acid molecules encoding these antibodies, molecules, fragments or variants.

The present invention also provides antibodies (including molecules comprising, or alternatively consisting of, antibody fragments or variants) that immunospecifically bind to a polypeptide or polypeptide fragment of B Lymphocyte Stimulator, wherein said antibodies comprise, or alternatively consist of, one, two, three, or more VH CDRs and one, two, three or more VL CDRs, as referred to in Table 1. In particular, the invention provides for antibodies that immunospecifically bind to a polypeptide or polypeptide fragment of B Lymphocyte Stimulator, wherein said antibodies comprise, or alternatively consist of, a VH CDR1 and a VL CDR1, a VH CDR1 and a VL CDR2, a VH CDR1 and a VL CDR3, a VH CDR2 and a VL CDR1, VH CDR2 and VL CDR2, a VH CDR2 and a VL CDR3, a VH CDR3 and a VH CDR1, a VH CDR3 and a VL CDR2, a VH CDR3 and a VL CDR3, or any combination thereof, of the VH CDRs and VL CDRs referred to in Table 1. In a preferred embodiment, one or more of these combinations are from the same scFv as disclosed in Table 1. Molecules comprising, or alternatively consisting of, fragments or variants of these antibodies, that immunospecifically bind to B Lymphocyte Stimulator are also encompassed by the invention, as are nucleic acid molecules encoding these antibodies, molecules, fragments or variants.

In a preferred embodiment the invention provides antibodies wherein the VH CDRX (where X=1, 2, or 3) and VL CDRY (where Y=1, 2, or 3) are from scFvs with the same specificity (i.e., from scFvs that bind soluble B Lymphocyte Stimulator, from scFvs that bind membrane-bound B Lymphocyte Stimulator, or from scFvs that bind both soluble and membrane-bound B Lymphocyte Stimulator. Molecules comprising, or alternatively consisting of, fragments or variants of these antibodies, that immunospecifically bind to B Lymphocyte Stimulator are also encompassed by the invention, as are nucleic acid molecules encoding these antibodies, molecules, fragments or variants.

The term "antibody," as used herein, refers to immunoglobulin molecules and immunologically active portions of immunoglobulin molecules, i.e., molecules that contain an antigen binding site that immunospecifically binds an antigen. As such, the term "antibody" encompasses not only whole antibody molecules, but also antibody fragments, as well as variants (including derivatives) of antibodies and antibody fragments. Antibodies of the invention include, but are not limited to, monoclonal, multispecific, human or chimeric antibodies, single chain antibodies, single chain Fvs (scFvs), Fab fragments, $F(ab')_2$ fragments, Fd fragments, disulfide-linked Fvs (sdFvs), antiidiotypic (anti-Id) antibodies (including, e.g., anti-Id antibodies to antibodies of the invention), and epitope-binding fragments of any of the above. The immunoglobulin molecules of the invention can be of any type (e.g., IgG, IgE, IgM, IgD, IgA and IgY), class (e.g., $IgG_1$, $IgG_2$, $IgG_3$, $IgG_4$, IgA, and $IgA_2$) or subclass of immunoglobulin molecule. The antibodies of the present invention also include molecules comprising, or alternatively consisting of, a polypeptide having an amino acid sequence of a portion of an amino acid sequence contained SEQ ID NOS:1–46, 321–329, 834–872, 1563–1595, or 1881–1908. Preferably, an antibody of the invention comprises, or alternatively consists of, a polypeptide having an amino acid sequence of a VH domain, VH CDR, VL domain, or VL CDR of any one those contained in the sequences referred to in Table 1. Antibodies of the invention also include molecules comprising, or alternatively consisting of, fragments or variants of the above antibodies that immunospecifically bind B Lymphocyte Stimulator.

Most preferably the antibodies of the present invention are whole antibodies or antibody fragments that immunospecifically bind human B Lymphocyte Stimulator. Antibody fragments of the invention that immunospecifically bind human B Lymphocyte Stimulator include, but are not limited to, Fab, Fab' and $F(ab')_2$, Fd fragments, single-chain Fvs (scFv), single-chain antibodies, disulfide-linked Fvs (sdFvs), fragments comprising, or alternatively consisting of, either a VL or VH domain, and epitope binding fragments of any of the above.

B Lymphocyte Stimulator-binding antibody fragments, including single-chain antibodies, may comprise, or alternatively consist of, the variable region(s) alone or in combination with the entirety or a portion of the following: hinge region, CH1, CH2, and CH3 domains. In a preferred embodiment, the antibodies of the invention comprise, or alternatively consist of, a polypeptide that immunospecifically binds to B Lymphocyte Stimulator, said polypeptides comprise, or alternatively consist of, one, two, three, four, five, six or more CDRs referred to in Table 1, preferably a polypeptide having an amino acid sequence of a VH CDR3 and/or a VL CDR3 of contained SEQ ID NOS:1–46, 321–329, 834–872, 1563–1595, or 1881–1908 as disclosed in Table 1. Most preferably, antibodies of the invention comprise, or alternatively consist of, one, two, three, four, five, six or more CDRs from the same scFv, as referred to in Table 1. The antibodies of the invention may be from any animal origin, including birds and mammals. Preferably, the antibodies are human, murine (e.g., mouse and rat), donkey, sheep, rabbit, goat, guinea pig, camel, horse, or chicken. Most preferably, the antibodies are human antibodies. As used herein, "human" antibodies include antibodies having the amino acid sequence of a human immunoglobulin and include antibodies isolated from human immunoglobulin libraries and xenomice or other organisms that have been genetically engineered to produce human antibodies. For a detailed discussion of a few of the technologies for producing human antibodies and human monoclonal antibodies and protocols for producing such antibodies, see, e.g., PCT publications WO 98/24893; WO 92/01047; WO 96/34096; WO 96/33735; European Patent No. 0 598 877; U.S. Pat. Nos. 5,413,923; 5,625,126; 5,633,425; 5,569,825; 5,661,016; 5,545,806; 5,814,318; 5,885,793; 5,916,771; and 5,939,598; and Lonberg and Huszar, Int. Rev. Immunol. 13:65–93 (1995), which are incorporated by reference herein in their entirety. Human antibodies or "humanized" chimeric monoclonal antibodies can be produced using techniques described herein or otherwise known in the art. For example, methods for producing chimeric antibodies are known in the art. See, for review the following references which are hereby incorporated in their entirety: Morrison, *Science* 229:1202 (1985); Oi et al., *BioTechniques* 4:214 (1986); Cabilly et al., U.S. Pat. No. 4,816,567; Taniguchi et al., EP 171496; Morrison et al., EP 173494; Neuberger et al., WO 8601533; Robinson et al., WO 8702671; Boulianne et al., *Nature* 312:643 (1984); Neuberger et al., *Nature* 314:268 (1985). In addition, companies such as Abgenix, Inc. (Freemont, Calif.) and Genpharm (San Jose, Calif.) can be engaged to provide human antibodies directed against a selected antigen using technology similar to that described above.

The antibodies of the present invention may be monovalent, bivalent, trivalent or multivalent. For example, monovalent scFvs can be multimerized either chemically or by association with another protein or substance. An scFv that is fused to a hexahistidine tag or a Flag tag can be multimerized using Ni-NTA agarose (Qiagen) or using anti-Flag antibodies (Stratagene, Inc.).

The antibodies of the present invention may be monospecific, bispecific, trispecific or of greater multispecificity. Multispecific antibodies may be specific for different epitopes of a B Lymphocyte Stimulator polypeptide, or fragment thereof, or may be specific for both a B Lymphocyte Stimulator polypeptide, or fragment thereof, and a heterologous epitope, such as a heterologous polypeptide or solid support material. See, e.g., PCT publications WO 93/17715; WO 92/08802; WO 91/00360; WO 92/05793; Tutt, et al., J. Immunol. 147:60–69 (1991); U.S. Pat. Nos. 4,474,893; 4,714,681; 4,925,648; 5,573,920; 5,601,819; Kostelny et al., J. Immunol. 148:1547–1553 (1992).

The antibodies of the invention (including molecules comprising, or alternatively consisting of, antibody fragments or variants thereof) may bind immunospecifically to murine B Lymphocyte Stimulator (e.g., a polypeptide having the amino acid sequence of human B Lymphocyte Stimulator (SEQ ID NOS:3228 and/or 3229) or B Lymphocyte Stimulator expressed on human monocytes; murine B Lymphocyte Stimulator (SEQ ID NOS:3230 and/or 3231) or B Lymphocyte Stimulator expressed on murine monocytes; rat B Lymphocyte Stimulator (either the soluble forms as given in SEQ ID NOS:3232, 3233, 3234 and/or 3235 or in a membrane associated form, e.g., on the surface of rat monocytes); or monkey B Lymphocyte Stimulator (e.g., the monkey B Lymphocyte Stimulator polypeptides of SEQ ID NOS:3236 and/or 3237, the soluble form of monkey B Lymphocyte Stimulator, or B Lymphocyte Stimulator expressed on monkey monocytes), preferably the antibodies of the invention bind immunospecifically to human B Lymphocyte Stimulator. Preferably, the antibodies of the invention bind immunospecifically to human and monkey B Lymphocyte Stimulator. Also preferably, the antibodies of the invention bind immunospecifically to human B Lymphocyte Stimulator and murine B Lymphocyte Stimulator. More preferably, antibodies of the invention, bind immunospecifically and with higher affinity to human B Lymphocyte Stimulator than to murine B Lymphocyte Stimulator.

Antibodies of the present invention may also be described or specified in terms of their cross-reactivity. Antibodies that do not bind any other analog, ortholog, or homolog of a polypeptide of the present invention are included. Antibodies that bind polypeptides with at least 95%, at least 90%, at least 85%, at least 80%, at least 75%, at least 70%, at least 65%, at least 60%, at least 55%, and at least 50% identity (as calculated using methods known in the art and described herein) to a polypeptide of the present invention are also included in the present invention. In a specific embodiment, antibodies of the present invention cross react with APRIL (SEQ ID NO:3239; GenBank Accession No. AF046888; J. Exp. Med. 188(6):1185–1190; PCT International Publication WO97/33902). In specific embodiments, antibodies of the present invention cross-react with murine, rat and/or rabbit homologs of human proteins and the corresponding epitopes thereof. Antibodies that do not bind polypeptides with less than 95%, less than 90%, less than 85%, less than 80%, less than 75%, less than 70%, less than 65%, less than 60%, less than 55%, and less than 50% identity (as calculated using methods known in the art and described herein) to a polypeptide of the present invention are also included in the present invention. In a specific embodiment, the above-described cross-reactivity is with respect to any single specific antigenic or immunogenic polypeptide, or combination(s) of 2, 3, 4, 5, or more of the specific antigenic and/or immunogenic polypeptides disclosed herein. Further included in the present invention are antibodies which bind polypeptides encoded by polynucleotides which hybridize to a polynucleotide of the present invention under hybridization conditions (as described herein).

In preferred embodiments, the antibodies of the present invention (including molecules comprising, or alternatively consisting of, antibody fragments or variants thereof), immunospecifically bind to B Lymphocyte Stimulator and do not cross-react with any other antigens. In more preferred embodiments, the antibodies of the invention immunopecifically bind to B Lymphocyte Stimulator and do not cross-react with TRAIL, APRIL, Endokine-alpha, TNF-alpha, TNF-beta, Fas-L or LIGHT.

The present invention also provides for a nucleic acid molecule, generally isolated, encoding an antibody of the invention (including molecules comprising, or alternatively consisting of, antibody fragments or variants thereof). In one embodiment, a nucleic acid molecule of the invention encodes an antibody comprising, or alternatively consisting of, a VH domain having an amino acid sequence of any one of the VH domains referred to in Table 1. In another embodiment, a nucleic acid molecule of the present invention encodes an antibody comprising, or alternatively consisting of, a VH CDR1 having an amino acid sequence of any one of the VH CDR1s referred to in Table 1. In another embodiment, a nucleic acid molecule of the present invention encodes an antibody comprising, or alternatively consisting of, a VH CDR2 having an amino acid sequence of any one of the VH CDR2s referred to in Table 1. In yet another embodiment, a nucleic acid molecule of the present invention encodes an antibody comprising, or alternatively consisting of, a VH CDR3 having an amino acid sequence of any one of the VH CDR3s referred to in Table 1. Nucleic acid molecules encoding antibodies that immunospecifically bind B Lymphocyte Stimulator and comprise, or alternatively consist of, fragments or variants of the VH domains and/or VH CDRs are also encompassed by the invention.

In another embodiment, a nucleic acid molecule of the invention encodes an antibody (including molecules comprising, or alternatively consisting of, antibody fragments or variants thereof), comprising, or alternatively consisting of, a VL domain having an amino acid sequence of any one of the VL domains referred to in Table 1. In another embodiment, a nucleic acid molecule of the present invention encodes an antibody comprising, or alternatively consisting of, a VL CDR1 having amino acid sequence of any one of the VL CDR1s referred to in Table 1. In another embodiment, a nucleic acid molecule of the present invention encodes an antibody comprising, or alternatively consisting of, a VL CDR2 having an amino acid sequence of any one of the VL CDR2s referred to in Table 1. In yet another embodiment, a nucleic acid molecule of the present invention encodes an antibody comprising, or alternatively consisting of, a VL CDR3 having an amino acid sequence of any one of the VL CDR3s referred to in Table 1. Nucleic acid encoding antibodies that immunospecifically bind B Lymphocyte Stimulator and comprise, or alternatively consist of, fragments or variants of the VL domains and/or VLCDR(s) are also encompassed by the invention.

In another embodiment, a nucleic acid molecule of the invention encodes an antibody (including molecules comprising, or alternatively consisting of, antibody fragments or variants thereof), comprising, or alternatively consisting of, a VH domain having an amino acid sequence of any one of the VH domains referred to in Table 1 and a VL domain having an amino acid sequence of any one of the VL domains referred to in Table 1. In another embodiment, a nucleic acid molecule of the invention encodes an antibody comprising, or alternatively consisting of, a VH CDR1, a VL CDR1, a VH CDR2, a VL CDR2, a VH CDR3, a VL CDR3, or any combination thereof having an amino acid sequence referred to in Table 1. Nucleic acid encoding antibodies that immunospecifically bind B Lymphocyte Stimulator and comprise, or alternatively consist of, fragments or variants of the VL and/or domains and/or VHCDR(s) and/or VLCDR(s) are also encompassed by the invention.

The present invention also provides antibodies that comprise, or alternatively consist of, variants (including derivatives) of the VH domains, VH CDRs, VL domains, and VL CDRs described herein, which antibodies immunospecifically bind to B Lymphocyte Stimulator. Standard techniques known to those of skill in the art can be used to introduce mutations in the nucleotide sequence encoding a molecule of the invention, including, for example, site-directed mutagenesis and PCR-mediated mutagenesis which result in amino acid substitutions. Preferably, the variants (including derivatives) encode less than 50 amino acid substitutions, less than 40 amino acid subsitutions, less than 30 amino acid substitutions, less than 25 amino acid substitutions, less than 20 amino acid substitutions, less than 15 amino acid substitutions, less than 10 amino acid substitutions, less than 5 amino acid substitutions, less than 4 amino acid substitutions, less than 3 amino acid substitutions, or less than 2 amino acid substitutions relative to the reference VH domain, VHCDR1, VHCDR2, VHCDR3, VL domain, VLCDR1, VLCDR2, or VLCDR3. In specific embodiments, the variants encode substitutions of VHCDR3. In a preferred embodiment, the variants have conservative amino acid substitutions at one or more predicted non-essential amino acid residues. A "conservative amino acid substitution" is one in which the amino acid residue is replaced with an amino acid residue having a side chain with a similar charge. Families of amino acid residues having side chains with similar charges have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). Alternatively, mutations can be introduced randomly along all or part of the coding sequence, such as by saturation mutagenesis, and the resultant mutants can be screened for biological activity to identify mutants that retain activity (e.g., the ability to bind B Lymphocyte Stimulator). Following mutagenesis, the encoded protein may routinely be expressed and the functional and/or biological activity of the encoded protein, (e.g., ability to immunospecifically bind B Lymphocyte Stimulator) can be determined using techniques described herein or by routinely modifying techniques known in the art.

The antibodies of the invention include derivatives (i.e., variants) that are modified, e.g., by the covalent attachment of any type of molecule to the antibody such that covalent attachment does not affect the ability of the antibody to immunospecifically bind to B Lymphocyte Stimulator. For example, but not by way of limitation, derivatives of the invention include antibodies that have been modified, e.g., by glycosylation, acetylation, pegylation, phosphorylation, amidation, derivatization by known protecting blocking groups, proteolytic cleavage, linkage to a cellular ligand or other protein, etc. Any of numerous chemical modifications may be carried out by known techniques, including, but not limited to, specific chemical cleavage, acetylation, formylation, metabolic synthesis of tunicamycin, etc. Additionally, the derivative may contain one or more non-classical amino acids.

In a specific embodiment, an antibody of the invention (including a molecule comprising, or alternatively consisting of, an antibody fragment or variant thereof), that immunospecifically binds B Lymphocyte Stimulator, comprises, or alternatively consists of, an amino acid sequence encoded by a nucleotide sequence that hybridizes to a nucleotide sequence that is complementary to that encoding one of the VH or VL domains referred to in Table 1 under stringent conditions, e.g., hybridization to filter-bound DNA in 6× sodium chloride/sodium citrate (SSC) at about 45° C. followed by one or more washes in 0.2×SSC/0.1% SDS at about 50–65° C., under highly stringent conditions, e.g., hybridization to filter-bound nucleic acid in 6×SSC at about 45° C. followed by one or more washes in 0.1×SSC/0.2% SDS at about 68° C., or under other stringent hybridization conditions which are known to those of skill in the art (see, for example, Ausubel, F. M. et al., eds., 1989, *Current Protocols in Molecular Biology*, Vol. I, Green Publishing Associates, Inc. and John Wiley & Sons, Inc., New York at pages 6.3.1–6.3.6 and 2.10.3). In another embodiment, an antibody of the invention that immunospecifically binds to B Lymphocyte Stimulator, comprises, or alternatively consists of, an amino acid sequence encoded by a nucleotide sequence that hybridizes to a nucleotide sequence that is complementary to that encoding one of the VH CDRs or VL CDRs referred to in Table 1 under stringent conditions, e.g., hybridization under conditions as described above, or under other stringent hybridization conditions which are known to those of skill in the art. In another embodiment, an antibody of the invention that immunospecifically binds to B Lymphocyte Stimulator, comprises, or alternatively consists of, an amino acid sequence encoded by a nucleotide sequence that hybridizes to a nucleotide sequence that is complementary to that encoding one of the VH CDR3s referred to in Table 1 under stringent conditions e.g., hybridization under conditions as described above, or under other stringent hybridization conditions which are known to those of skill in the art. Nucleic acid molecules encoding these antibodies are also encompassed by the invention.

In another embodiment, an antibody (including a molecule comprising, or alternatively consisting of, an antibody fragment or variant thereof), that immunospecifically binds to B Lymphocyte Stimulator comprises, or alternatively consists of, a polypeptide having an amino acid sequence that is at least 35%, at least 40%, at least 45%, at least 50%, at least 55%, at least 60%, at least 65%, at least 70%, at least 75%, at least 80%, at least 85%, at least 90%, at least 95%, or at least 99% identical, to any one of the VH domains referred to in Table 1. In another embodiment, an antibody of the invention that immunospecifically binds to B Lymphocyte Stimulator comprises, or alternatively consists of, a polypeptide having an amino acid sequence that is at least 35%, at least 40%, at least 45%, at least 50%, at least 55%, at least 60%, at least 65%, at least 70%, at least 75%, at least 80%, at least 85%, at least 90%, at least 95%, or at least 99% identical, to any one of the VH CDRs referred to in Table 1. In another embodiment, an antibody of the invention that immunospecifically binds to B Lymphocyte Stimulator comprises, or alternatively consists of, a polypeptide having an amino acid sequence that is at least 35%, at least 40%, at least 45%, at least 50%, at least 55%, at least 60%, at least 65%, at least 70%, at least 75%, at least 80%, at least 85%, at least 90%, at least 95%, or at least 99% identical to any one of the VH CDR3s referred to in Table 1. Nucleic acid molecules encoding these antibodies are also encompassed by the invention.

In another embodiment, an antibody of the invention (including a molecule comprising, or alternatively consisting of, an antibody fragment or variant thereof), that immunospecifically binds to B Lymphocyte Stimulator comprises, or alternatively consists of, a polypeptide having an amino acid sequence that is at least 35%, at least 40%, at least 45%, at least 50%, at least 55%, at least 60%, at least 65%, at least 70%, at least 75%, at least 80%, at least 85%, at least 90%, at least 95%, or at least 99% identical, to any one of the VL domains referred to in Table 1. In another embodiment, an antibody of the invention that immunospecifically binds to B Lymphocyte Stimulator comprises, or alternatively consists of, a polypeptide having an amino acid sequence that is at least 35%, at least 40%, at least 45%, at least 50%, at least 55%, at least 60%, at least 65%, at least 70%, at least 75%, at least 80%, at least 85%, at least 90%, at least 95%, or at least 99% identical, to any one of the VL CDRs referred to in Table 1. In another embodiment, an antibody of the invention that immunospecifically binds to B Lymphocyte Stimulator comprises, or alternatively consists of, a polypeptide having an amino acid sequence that is at least 35%, at least 40%, at least 45%, at least 50%, at least 55%, at least 60%, at least 65%, at least 70%, at least 75%, at least 80%, at least 85%, at least 90%, at least 95%, or at least 99% identical, to any one of the VL CDR3s referred to in Table 1. Nucleic acid molecules encoding these antibodies are also encompassed by the invention.

Antibodies of the present invention (including molecules comprising, or alternatively consisting of, antibody fragments or variants thereof) may also be described or specified in terms of their binding affinity for to B Lymphocyte Stimulator polypeptides or fragments or variants of B Lymphocyte Stimulator polypeptides (e.g., to the soluble form of B Lymphocyte Stimulator and/or membrane-bound form of B Lymphocyte Stimulator). In specific embodiments, antibodies of the invention bind B Lymphocyte Stimulator polypeptides, or fragments or variants thereof, with a dissociation constant or $K_D$ of less than or equal to $5\times10^{-2}$ M, $10^{-2}$ M, $5\times10^{-3}$ M, $10^{-3}$ M, $5\times10^{-4}$ M, $10^{-4}$ M, $5\times10^{-5}$ M, or $10^{-5}$ M. More preferably, antibodies of the invention bind B Lymphocyte Stimulator polypeptides or fragments or variants thereof with a dissociation constant or $K_D$ less than or equal to $5\times10^{-6}$ M, $10^{-6}$ M, $5\times10^{-7}$ M, $10^{-7}$M, $5\times10^{-8}$ M, or $10^{-8}$ M. Even more preferably, antibodies of the invention bind B Lymphocyte Stimulator polypeptides or fragments or variants thereof with a dissociation constant or $K_D$ less than or equal to $5\times10^{-9}$ M, $10^{-9}$ M, $5\times10^{-10}$ M, $10^{-10}$ M, $5\times10^{-11}$ M, $10^{-11}$ M, $5\times10^{-12}$ M, $10^{-12}$ M, $5\times^{-13}$ M, $10^{-13}$ M, $5\times10^{-14}$ M, $10^{-14}$ M, $5\times10^{-15}$ M, or $10^{-15}$ M. The invention encompasses antibodies that bind B Lymphocyte Stimulator polypeptides with a dissociation constant or $K_D$ that is within any one of the ranges that are between each of the individual recited values.

In specific embodiments, antibodies of the invention bind B Lymphocyte Stimulator polypeptides or fragments or variants thereof with an off rate ($k_{off}$) of less than or equal to $5\times10^{-2}$ $sec^{-1}$, $10^{-2}$ $sec^{-1}$, $5\times10^{-3}$ $sec^{-1}$ or $10^{-3}$ $sec^{-1}$. More preferably, antibodies of the invention bind B Lymphocyte Stimulator polypeptides or fragments or variants thereof with an off rate ($k_{off}$) less than or equal to $5\times10^{-4}$ $sec^{-1}$, $10^{-4}$ $sec^{-1}$, $5\times10^{-5}$ $sec^{-1}$, or $10^{-5}$ $sec^{-1}5\times10^{-6}$ $sec^{-1}$, $10^{-6}$ $sec^{-1}$, $5\times10^{-7}$ $sec^{-1}$ or $10^{-7}$ $sec^{-1}$. The invention encompasses antibodies that bind B Lymphocyte Stimulator polypeptides with an off rate ($k_{off}$) that is within any one of the ranges that are between each of the individual recited values.

In other embodiments, antibodies of the invention bind B Lymphocyte Stimulator polypeptides or fragments or variants thereof with an on rate ($k_{on}$) of greater than or equal to $10^3$ $M^{-1}$ $sec^{-1}$, $5\times10^3$ $M^{-1}$ $sec^{-1}$, $10^4$ $M^{-1}$ $sec^{-1}$ or $5\times10^4$ $M^{-1}$ $sec^{-1}$. More preferably, antibodies of the invention bind B Lymphocyte Stimulator polypeptides or fragments or variants thereof with an on rate ($k_{on}$) greater than or equal to $10^5$ $M^{-1}$ $sec^{-1}$, $5\times10^5$ $M^{-1}$ $sec^{-1}$, $10^6$ $M^{-1}$ $sec^{-1}$, or $5\times10^6$ $M^{-1}$ $sec^{-1}$ or $10^7$ $M^{-1}$ $sec^{-1}$. The invention encompasses antibodies that bind B Lymphocyte Stimulator polypeptides with on rate ($k_{on}$) that is within any one of the ranges that are between each of the individual recited values.

The invention also encompasses antibodies (including molecules comprising, or alternatively consisting of, antibody fragments or variants thereof) that have one or more of the same biological characteristics as one or more of the antibodies described herein. By "biological characteristics" is meant, the in vitro or in vivo activities or properties of the antibodies, such as, for example, the ability to bind to B Lymphocyte Stimulator (e.g., the soluble form of B Lymphocyte Stimulator, the membrane-bound form of B Lymphocyte Stimulator, the soluble form and membrane-bound form of B Lymphocyte Stimulator), and/or an antigenic and/or epitope region of B Lymphocyte Stimulator), the ability to substantially block B Lymphocyte Stimulator/B Lymphocyte Stimulator receptor (e.g., TACI—GenBank accession number AAC51790 and/or BCMA—GenBank accession number NP_001183) binding, or the ability to block B Lymphocyte Stimulator mediated biological activity (e.g., stimulation of B cell proliferation and immunoglobulin production). Optionally, the antibodies of the invention will bind to the same epitope as at least one of the antibodies specifically referred to herein. Such epitope binding can be routinely determined using assays known in the art.

The present invention also provides for antibodies (including molecules comprising, or alternatively consisting of, antibody fragments or variants thereof), that neutralize B Lymphocyte Stimulator or a fragment thereof, said antibodies comprising, or alternatively consisting of, a portion (i.e., a VH domain, VL domain, VH CDR1, VH CDR2, VH CDR3, VL CDR1, VL CDR2, or VL CDR3) of an scFv referred to in Table 1, more preferably having an amino acid sequence contained in SEQ ID NOS:834–872, 1570–1595, or 1886–1908, and even more preferably having an amino acid sequence contained in SEQ ID NOS:1–46, 321–329, 1563–1569, or 1881–1885 as disclosed in Table 1, or a fragment or variant thereof. By an antibody that "neutralizes B Lymphocyte Stimulator or a fragment thereof" is meant an antibody that diminishes or abolishes the ability of B Lymphocyte Stimulator to bind to its receptor (e.g., TACI and BCMA) to stimulate B cell proliferation, to stimulate immunoglobulin secretion by B cells, and/or to stimulate the B Lymphocyte Stimulator receptor signalling cascade. In one embodiment, an antibody that neutralizes B Lymphocyte Stimulator or a fragment thereof, comprises, or alternatively consists of, a polypeptide having the amino acid sequence of a VH domain contained in SEQ ID NOS:1–46, 321–329, 834–872, 1563–1595, or 1881–1908 as disclosed in Table 1, or a fragment or variant thereof. In another embodiment, an antibody that neutralizes B Lymphocyte Stimulator or a fragment thereof, comprises, or alternatively consists of, a polypeptide having the amino acid sequence of a VL domain contained in SEQ ID NOS:1–46, 321–329, 834–872, 1563–1595, or 1881–1908 as disclosed in Table 1, or a fragment or variant thereof. In another embodiment, an antibody that neutralizes B Lymphocyte Stimulator or a fragment thereof, comprises, or alternatively consists of, a polypeptide having the amino acid sequence of a VH CDR domain in SEQ ID NOS:1–46, 321–329, 834–872, 1563–1595, or 1881–1908 as disclosed in Table 1, or a fragment or variant thereof. In a preferred embodiment, an antibody that neutralizes B Lymphocyte Stimulator or a fragment thereof, comprises, or alternatively consists of, a polypeptide having the amino acid sequence of a VH CDR3 contained in SEQ ID NOS:1–46, 321–329, 834–872, 1563–1595, or 1881–1908 as disclosed in Table 1, or a fragment or variant thereof. In another embodiment, an antibody that neutralizes B Lymphocyte Stimulator or a fragment thereof, comprises, or alternatively consists of, a polypeptide having the amino acid sequence of a VL CDR domain contained in SEQ ID NOS:1–46, 321–329, 834–872, 1563–1595, or 1881–1908 as disclosed in Table 1, or a fragment or variant thereof. In another preferred embodiment, an antibody that neutralizes B Lymphocyte Stimulator or a fragment thereof, comprises, or alternatively consists of, a polypeptide having the amino acid sequence of a VL CDR3 contained in SEQ ID NOS:1–46, 321–329, 834–872, 1563–1595, or 1881–1908 as disclosed in Table 1, or a fragment or variant thereof. Nucleic acid molecules encoding these antibodies are also encompassed by the invention.

The present invention also provides for antibodies (including molecules comprising, or alternatively consisting of, antibody fragments or variants thereof), that inhibit (i.e., diminish or abolish) B Lymphocyte Stimulator mediated B cell proliferation as determined by any method known in the art such as, for example, the assays described in Examples 21 and 22, infra, said antibodies comprising, or alternatively consisting of, a portion (e.g., a VH domain, VL domain, VH CDR1, VH CDR2, VH CDR3, VL CDR1, VL CDR2, or VL CDR3) of an scFv having an amino acid sequence SEQ ID NOS:834–872, 1570–1595, 1886–1908, and even more preferably having an amino acid sequence SEQ ID NOS: 1–46, 321–329, 1563–1569, 1881–1885 as disclosed in Table 1 or a fragment or variant thereof. In one embodiment, an antibody that inhibits B Lymphocyte Stimulator mediated B cell proliferation, comprises, or alternatively consists of, a polypeptide having the amino acid sequence of a VH domain contained in SEQ ID NOS:1–46, 321–329, 834–872, 1563–1595, or 1881–1908, as disclosed in Table 1, or a fragment or variant thereof. In another embodiment, an antibody that inhibits B Lymphocyte Stimulator mediated B cell proliferation, comprises, or alternatively consists of, a polypeptide having the amino acid sequence of a VL domain contained in SEQ ID NOS:1–46, 321–329, 834–872, 1563–1595, or 1881–1908 as disclosed in Table 1, or a fragment or variant thereof. In a preferred embodiment, an antibody that inhibits B Lymphocyte Stimulator mediated B cell proliferation, comprises, or alternatively consists of, a polypeptide having the amino acid sequence of a VH CDR3 contained in SEQ ID NOS:1–46, 321–329, 834–872, 1563–1595, or 1881–1908 as disclosed in Table 1, or a fragment or variant thereof. In another preferred embodiment, an antibody that inhibits B Lymphocyte Stimulator mediated B cell proliferation, comprises, or alternatively consists of, a polypeptide having the amino acid sequence of a VL CDR3 contained SEQ ID NOS:1–46, 321–329, 834–872, 1563–1595, or 1881–1908 as disclosed in Table 1, or a fragment or variant thereof. Nucleic acid molecules encoding these antibodies are also encompassed by the invention.

The present invention also provides for antibodies (including molecules comprising, or alternatively consisting of, antibody fragments or variants thereof), that enhance the activity of B Lymphocyte Stimulator or a fragment thereof, said antibodies comprising, or alternatively consisting of, a portion (i.e., a VH domain, VL domain, VH CDR1, VH CDR2, VH CDR3, VL CDR1, VL CDR2, or VL CDR3) of an scFv having an amino acid sequence SEQ ID NOS: 834–872, 1570–1595, or 1886–1908, and preferably having an amino acid sequence of SEQ ID NOS:1–46, 321–329, 1563–1569, or 1881–1885, as disclosed in Table 1, or a fragment or variant thereof. By an antibody that "enhances the activity of B Lymphocyte Stimulator or a fragment thereof" is meant an antibody increases the ability of B Lymphocyte Stimulator to bind to its receptor (e.g., TACI or BCMA), to stimulate B cell proliferation, to stimulate immunoglobulin secretion by B cells, and/or to stimulate the B Lymphocyte Stimulator receptor signalling cascade. In one embodiment, an antibody that enhances the activity of B Lymphocyte Stimulator or a fragment thereof, comprises, or alternatively consists of, a polypeptide having the amino acid sequence of a VH domain contained in SEQ ID NOS:1–46, 321–329, 834–872, 1563–1595, or 1881–1908 as disclosed in Table 1, or a fragment or variant thereof. In another embodiment, an antibody that enhances the activity of B Lymphocyte Stimulator or a fragment thereof, comprises, or alternatively consists of, a polypeptide having the amino acid sequence of a VL domain contained in SEQ ID NOS:1–46, 321–329, 834–872, 1563–1595, or 1881–1908 as disclosed in Table 1, or a fragment or variant thereof. In another embodiment, an antibody that enhances the activity of B Lymphocyte Stimulator or a fragment thereof, comprises, or alternatively consists of, a polypeptide having the amino acid sequence of a VH CDR domain contained in SEQ ID NOS:1–46, 321–329, 834–872, 1563–1595, or 1881–1908 as disclosed in Table 1, or a fragment or variant thereof. In a preferred embodiment, an antibody that enhances the activity of B Lymphocyte Stimulator or a fragment thereof, comprises, or alternatively consists of, a polypeptide having the amino acid sequence of a VH CDR3 contained in SEQ ID NOS:1–46, 321–329, 834–872, 1563–1595, or 1881–1908 as disclosed in Table 1, or a fragment or variant thereof. In another embodiment, an antibody that enhances B Lymphocyte Stimulator or a fragment thereof, comprises, or alternatively consists of, a polypeptide having the amino acid sequence of a VL CDR domain contained in SEQ ID NOS:1–46, 321–329, 834–872, 1563–1595, or 1881–1908 as disclosed in Table 1, or a fragment or variant thereof. In another preferred embodiment, an antibody that enhances the activity of B Lymphocyte Stimulator or a fragment thereof, comprises, or alternatively consists of, a polypeptide having the amino acid sequence of a VL CDR3 contained in SEQ ID NOS: 1–46, 321–329, 834–872, 1563–1595, or 1881–1908 as disclosed in Table 1, or a fragment or variant thereof. Nucleic acid molecules encoding these antibodies are also encompassed by the invention.

The present invention also provides for antibodies (including molecules comprising, or alternatively consisting of, antibody fragments or variants thereof), that stimulate B Lymphocyte Stimulator mediated B cell proliferation as determined by any method known in the art, such as, for example, the assays described in Examples 21 and 22, infra, said antibodies comprising, or alternatively consisting of, a portion (e.g., a VH domain, VL domain, VH CDR1, VH CDR2, VH CDR3, VL CDR1, VL CDR2, or VL CDR3) of an scFv having an amino acid sequence of SEQ ID NOS: 834–872, 1570–1595, or 1886–1908, and even more preferably having an amino acid sequence of SEQ ID NOS: 1–46, 321–329, 1563–1569, or 1881–1885 as disclosed in Table 1 or a fragment or variant thereof. In one embodiment, an antibody that stimulates B Lymphocyte Stimulator mediated B cell proliferation, comprises, or alternatively consists of, a polypeptide having the amino acid sequence of a VH domain contained in SEQ ID NOS:1–46, 321–329, 834–872, 1563–1595, or 1881–1908 as disclosed in Table 1, or a fragment or variant thereof. In another embodiment, an antibody that stimulates B Lymphocyte Stimulator mediated B cell proliferation, comprises, or alternatively consists of, a polypeptide having the amino acid sequence of a VL domain contained in SEQ ID NOS:1–46, 321–329, 834–872, 1563–1595, or 1881–1908 as disclosed in Table 1, or a fragment or variant thereof. In a preferred embodiment, an antibody that stimulates B Lymphocyte Stimulator mediated B cell proliferation, comprises, or alternatively consists of, a polypeptide having the amino acid sequence of a VH CDR3 contained in SEQ ID NOS:1–46, 321–329, 834–872, 1563–1595, or 1881–1908 as disclosed in Table 1, or a fragment or variant thereof. In another preferred embodiment, an antibody that stimulates B Lymphocyte Stimulator mediated B cell proliferation, comprises, or alternatively consists of, a polypeptide having the amino acid sequence of a VL CDR3 contained in SEQ ID NOS:1–46, 321–329, 834–872, 1563–1595, or 1881–1908 as disclosed in Table 1, or a fragment or variant thereof. Nucleic acid molecules encoding these antibodies are also encompassed by the invention.

Figure 1:
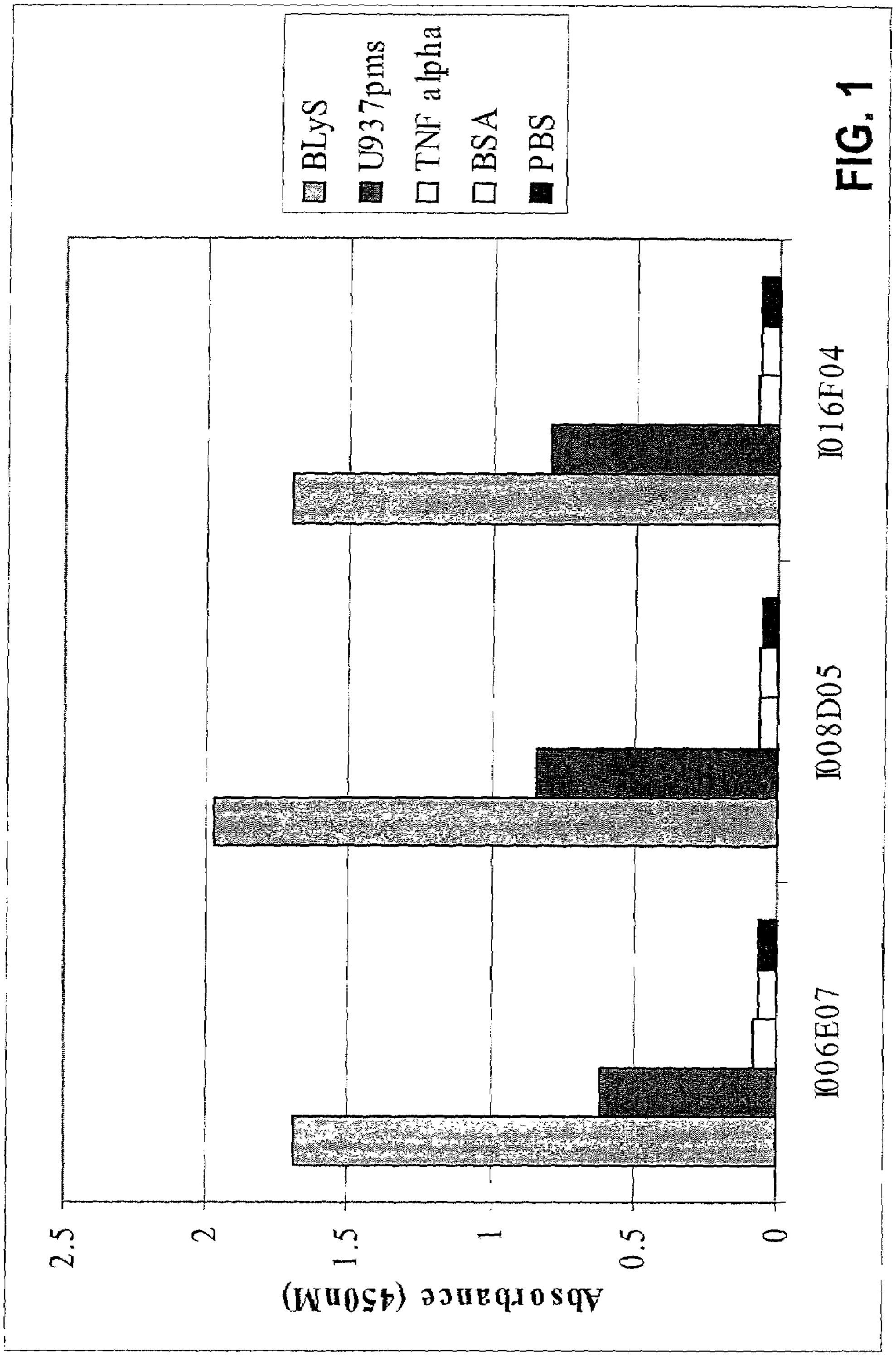
FIG. 1. ELISA results for three scFvs, I006E07, I008D05 and I016F04, that immunospecifically bind to U937 membranes, but not to bind to or cross-react with TNF-alpha or BSA.
Figure 2:
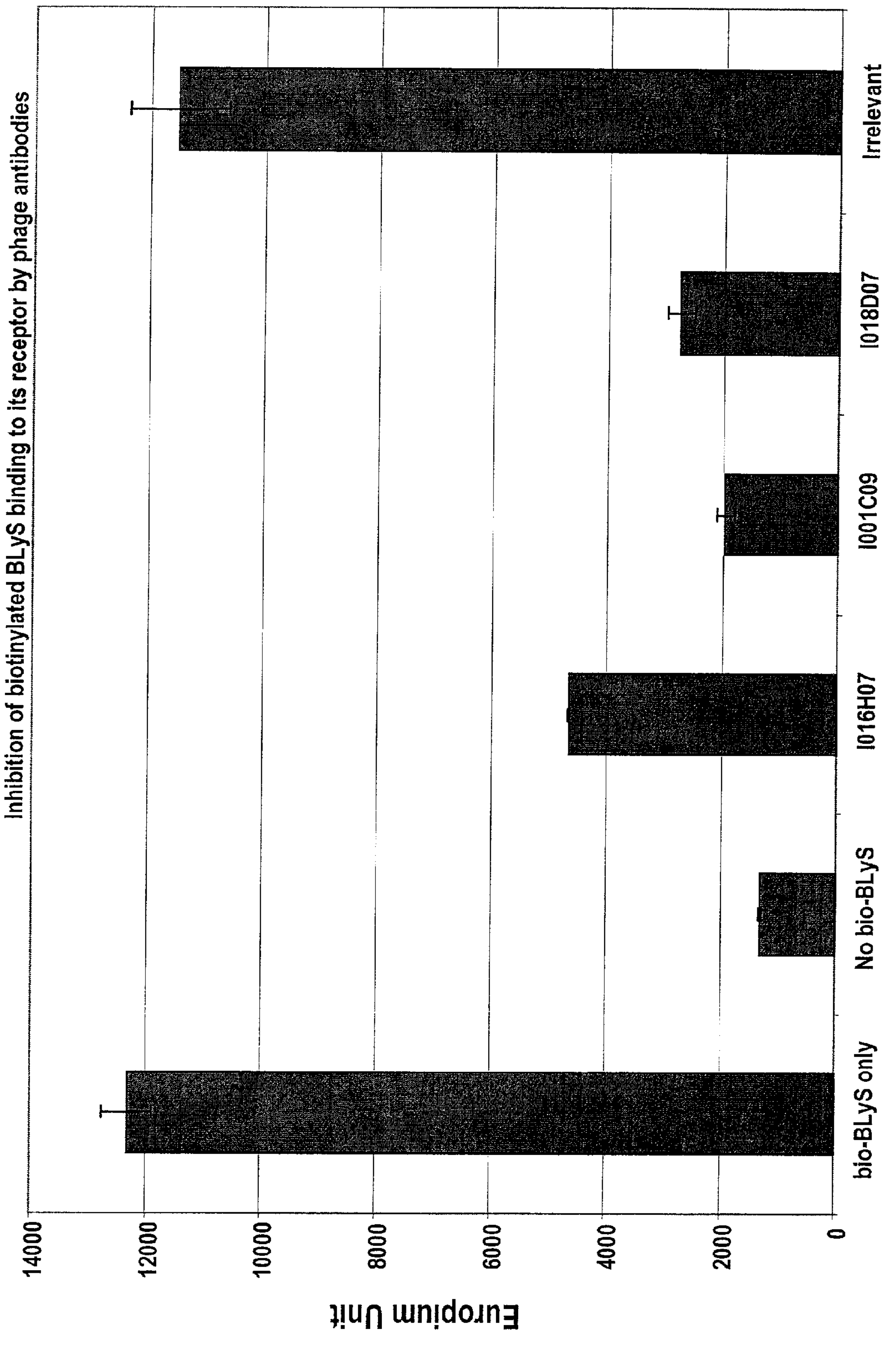
FIG. 2. The results for three scFvs, I016H07, I001C09 and I018D07, in a receptor inhibition assay.

The present invention also provides for fusion proteins comprising, or alternatively consisting of, an antibody (including molecules comprising, or alternatively consisting of, antibody fragments or variants thereof), that immunospecifically binds to B Lymphocyte Stimulator, and a heterologous polypeptide. Preferably, the heterologous polypeptide to which the antibody is fused to is useful for B-cell function or is useful to target the antibody to B-cells. In an alternative preferred embodiment, the heterologous polypeptide to which the antibody is fused to is useful for monocyte cell function or is useful to target the antibody to a monocyte. In another embodiment, the heterologous polypeptide to which the antibody is fused is albumin (including but not limited to recombinant human serum albumin or fragments or variants thereof (see, e.g., U.S. Pat. No. 5,876,969, issued Mar. 2, 1999, EP Patent 0 413 622, and U.S. Pat. No. 5,766,883, issued Jun. 16, 1998, herein incorporated by reference in their entirety)). In a preferred embodiment, antibodies of the present invention (including fragments or variants thereof) are fused with the mature form of human serum albumin (i.e., amino acids 1–585 of human serum albumin as shown in FIGS. 1 and 2 of EP Patent 0 322 094) which is herein incorporated by reference in its entirety. In another preferred embodiment, antibodies of the present invention (including fragments or variants thereof) are fused with polypeptide fragments comprising, or alternatively consisting of, amino acid residues 1-x of human serum albumin, where x is an integer from 1 to 585 and the albumin fragment has human serum albumin activity. In another preferred embodiment, antibodies of the present invention (including fragments or variants thereof) are fused with polypeptide fragments comprising, or alternatively consisting of, amino acid residues 1-z of human serum albumin, where z is an integer from 369 to 419, as described in U.S. Pat. No. 5,766,883 herein incorporated by reference in its entirety. Antibodies of the present invention (including fragments or variants thereof) may be fused to either the N- or C-terminal end of the heterologous protein (e.g., immunoglobulin Fc polypeptide or human serum albumin polypeptide).

In one embodiment, a fusion protein of the invention comprises, or alternatively consists of, a polypeptide having the amino acid sequence of any one or more of the VH domains referred to in Table 1 or the amino acid sequence of any one or more of the VL domains referred to in Table 1 or fragments or variants thereof, and a heterologous polypeptide sequence. In another embodiment, a fusion protein of the present invention comprises, or alternatively consists of, a polypeptide having the amino acid sequence of any one, two, three, or more of the VH CDRs referred to in Table 1, or the amino acid sequence of any one, two, three, or more of the VL CDRs referred to in Table 1, or fragments or variants thereof, and a heterologous polypeptide sequence. In a preferred embodiment, the fusion protein comprises, or alternatively consists of, a polypeptide having the amino acid sequence of, a VH CDR3 referred to in Table 1, or fragment or variant thereof, and a heterologous polypeptide sequence, which fusion protein immunospecifically binds to B Lymphocyte Stimulator. In another embodiment, a fusion protein comprises, or alternatively consists of a polypeptide having the amino acid sequence of at least one VH domain referred to in Table 1 and the amino acid sequence of at least one VL domain referred to in Table 1 or fragments or variants thereof, and a heterologous polypeptide sequence. Preferably, the VH and VL domains of the fusion protein correspond to the same scFv referred to in Table 1. In yet another embodiment, a fusion protein of the invention comprises, or alternatively consists of a polypeptide having the amino acid sequence of any one, two, three or more of the VH CDRs referred to in Table 1 and the amino acid sequence of any one, two, three or more of the VL CDRs referred to in Table 1, or fragments or variants thereof, and a heterologous polypeptide sequence. Preferably, two, three, four, five, six, or more of the VHCDR(s) or VLCDR(s) correspond to the same scFv referred to in Table 1. Nucleic acid molecules encoding these fusion proteins are also encompassed by the invention.

The present invention also provides: antibodies (including molecules comprising, or alternatively consisting of, antibody fragments or variants thereof), that immunospecifically bind to the soluble form of B Lymphocyte Stimulator; antibodies that immunospecifically bind to the membrane-bound form of B Lymphocyte Stimulator; and antibodies that immunospecifically bind to both the soluble form and membrane-bound form of B Lymphocyte Stimulator.

In one embodiment of the present invention, antibodies (including molecules comprising, or alternatively consisting of, antibody fragments or variants thereof) that immunospecifically bind to the soluble form of B Lymphocyte Stimulator, comprise, or alternatively consist of, a polypeptide having the amino acid sequence of any one or more of the VH domains contained in SEQ ID NOS:1563–1880 as disclosed in Table 1 and/or the amino acid sequence of any one or more of the VL domains contained in SEQ ID NOS: 1563–1880 as disclosed in Table 1, or fragment(s) or variant(s) (including derivative) thereof. Preferably, the VH and VL domains of the antibody correspond to the same scFv as disclosed in Table 1. In another embodiment, antibodies that immunospecifically bind to the soluble form of B Lymphocyte Stimulator are provided that comprise, or alternatively consist of, a polypeptide having the amino acid sequence of any one, two, three, or more of the VH CDRs contained SEQ ID NOS: 1563–1880 as disclosed in Table 1 and/or the amino acid sequence of any one, two, three, or more of the VL CDRs contained in SEQ ID NOS: 1563–1880 as disclosed in Table 1, or fragment(s) or variant(s) thereof. Preferably, two, three, four, five, six or more of the VH and VL CDRs of the antibody correspond to the same scFv as disclosed in Table 1. In a preferred embodiment, antibodies that immunospecifically bind to the soluble form of B Lymphocyte Stimulator are provided that comprise, or alternatively consist of, a polypeptide having the amino acid sequence of any one or more of the VH CDR3s contained in SEQ ID NOS: 1563–1880 as disclosed in Table 1 and/or the amino acid sequence of any one or more of the VL CDR3s contained in SEQ ID NOS: 1563–1880 as disclosed in Table 1, or fragment(s) or variant(s) thereof. Preferably, the VHCDR3 and VLCDR3 of the antibody correspond to the same scFv, as disclosed in Table 1. Nucleic acid molecules encoding these antibodies are also encompassed by the invention.

In another embodiment of the present invention, antibodies (including molecules comprising, or alternatively consisting of, antibody fragments or variants thereof) that immunospecifically bind to the membrane-bound form of B Lymphocyte Stimulator are provided that comprise, or alternatively consist of, a polypeptide having the amino acid sequence of any one or more of the VH domains contained in SEQ ID NOS: 1881–2128 as disclosed in Table 1 and/or the amino acid sequence of any one or more of the VL domains contained in SEQ ID NOS: 1881–2128 as disclosed in Table 1, or a fragment or variant thereof. Preferably, the VH and VL domains of the antibody correspond to the same scFv as disclosed in Table 1. In another embodiment, antibodies that immunospecifically bind to the membrane-bound form of B Lymphocyte Stimulator are provided that comprise, or alternatively consist of, a polypeptide having the amino acid sequence of any one, two, three, or more of the VH CDRs contained in SEQ ID NOS: 1881–2128 as disclosed in Table 1 and/or the amino acid sequence of any one, two, three, or more of the VL CDRs contained in SEQ ID NOS: 1881–2128 as disclosed in Table 1, or fragment(s) or variant(s) thereof. Preferably, two, three, four, five, six or more of the VH and VL CDRs of the antibody correspond to the same scFv as disclosed in Table 1. In a preferred embodiment, antibodies that immunospecifically bind to the membrane-bound form of B Lymphocyte Stimulator are provided that comprise, or alternatively consist of, a polypeptide having the amino acid sequence of any one or more of the VH CDR3s contained in SEQ ID NOS: 1881–2128 as disclosed in Table 1 and/or the amino acid sequence of any one or more of the VL CDR3s contained in SEQ ID NOS: 1881–2128 as disclosed in Table 1, or fragment(s) or variant(s) thereof. Preferably, the VHCDR3 and VLCDR3 of the antibody correspond to the same scFv, as disclosed in Table 1. Nucleic acid molecules encoding these antibodies are also encompassed by the invention.

In another embodiment of the present invention, antibodies (including molecules comprising, or alternatively consisting of, antibody fragments or variants thereof) that immunospecifically bind to the soluble form and membrane-bound form of B Lymphocyte Stimulator, are provided that comprise, or alternatively consist of, a polypeptide having the amino acid sequence of any one or more of the VH domains contained in SEQ ID NOS: 1–1562 as disclosed in Table 1 and/or the amino acid sequence of any one or more of the VL domains contained in SEQ ID NOS: 1–1562 as disclosed in Table 1, or a fragment or variant thereof. Preferably, the VH and VL domains of the antibody correspond to the same scFv as disclosed in Table 1. In another embodiment, antibodies that immunospecifically bind to the soluble form and membrane-bound form of B Lymphocyte Stimulator are provided that comprise, or alternatively consist of, a polypeptide having the amino acid sequence of any one, two, three, or more of the VH CDRs contained in SEQ ID NOS: 1–1562 as disclosed in Table 1 and/or the amino acid sequence of any one, two, three, or more of the VL CDRs contained in SEQ ID NOS: 1–1562 as disclosed in Table 1, or fragment(s) or variant(s) thereof. Preferably, two, three, four, five, six or more of the VH and VL CDRs of the antibody correspond to the same scFv as disclosed in Table 1. In a preferred embodiment, antibodies that immunospecifically bind to the soluble form and membrane-bound form of B Lymphocyte Stimulator are provided that comprise, or alternatively consist of, a polypeptide having the amino acid sequence of any one or more of the VH CDR3s contained in SEQ ID NOS: 1–1562, disclosed in Table 1 and/or the amino acid sequence of any one or more of the VL CDR3s contained in SEQ ID NOS: 1–1562, disclosed in Table 1, or fragment(s) or variant(s) thereof. Preferably, the VHCDR3 and VLCDR3 of the antibody correspond to the same scFv, as disclosed in Table 1.

The present invention also provides for mixtures of antibodies (including scFvs and other molecules comprising, or alternatively consisting of, antibody fragments or variants thereof) that immunospecifically bind to B Lymphocyte Stimulator, wherein the mixture has at least one, two, three, four, five or more different antibodies of the invention. In particular, the invention provides for mixtures of different antibodies that immunospecifically bind to the soluble form of B Lymphocyte Stimulator, the membrane-bound form of B Lymphocyte Stimulator, and/or both the membrane-bound form and soluble form of B Lymphocyte Stimulator. In specific embodiments, the invention provides mixtures of at least 2, preferably at least 4, at least 6, at least 8, at least 10, at least 12, at least 15, at least 20, or at least 25 different antibodies that immunospecifically bind to B Lymphocyte Stimulator, wherein at least 1, at least 2, at least 4, at least 6, or at least 10, antibodies of the mixture is an antibody of the invention. In a specific embodiment, each antibody of the mixture is an antibody of the invention.

The present invention also provides for panels of antibodies (including scFvs and other molecules comprising, or alternatively consisting of, antibody fragments or variants thereof) that immunospecifically bind to B Lymphocyte Stimulator, wherein the panel has at least one, two, three, four, five or more different antibodies of the invention. In particular, the invention provides for panels of different antibodies that immunospecifically bind to the soluble form of B Lymphocyte Stimulator, the membrane-bound form of B Lymphocyte Stimulator, and/or both the membrane-bound form and soluble form of B Lymphocyte Stimulator. In specific embodiments, the invention provides for panels of antibodies that have different affinities for B Lymphocyte Stimulator, different specificities for B Lymphocyte Stimulator, or different dissociation rates. The invention provides panels of at least 10, preferably at least 25, at least 50, at least 75, at least 100, at least 125, at least 150, at least 175, at least 200, at least 250, at least 300, at least 350, at least 400, at least 450, at least 500, at least 550, at least 600, at least 650, at least 700, at least 750, at least 800, at least 850, at least 900, at least 950, or at least 1000, antibodies. Panels of antibodies can be used, for example, in 96 well plates for assays such as ELISAs.

The present invention further provides for compositions comprising, one or more antibodies (including scFvs and other molecules comprising, or alternatively consisting of antibody fragments or variants of the invention). In one embodiment, a composition of the present invention comprises, one, two, three, four, five, or more antibodies that comprise or alternatively consist of, a polypeptide having an amino acid sequence of any one or more of the VH domains contained in SEQ ID NOS:1563–1880 as disclosed in Table 1, or a variant thereof. In another embodiment, a composition of the present invention comprises, one, two, three, four, five, or more antibodies that comprise, or alternatively consist of, a polypeptide having an amino acid sequence of any one or more of the VH CDR1s contained in SEQ ID NOS:1563–1880 as disclosed in Table 1, or a variant thereof. In another embodiment, a composition of the present invention comprises, one, two, three, four, five or more antibodies that comprise, or alternatively consist of, a polypeptide having an amino acid sequence of any one or more of the VH CDR2s contained in SEQ ID NOS:1563–1880 as disclosed in Table 1, or a variant thereof. In a preferred embodiment, a composition of the present invention comprises, one, two, three, four, five, or more antibodies that comprise, or alternatively consist of, a polypeptide having an amino acid sequence of any one or more of the VH CDR3s contained in SEQ ID NOS:1563–1880, as disclosed in Table 1 or a variant thereof.

The present invention further provides for compositions comprising, one or more antibodies (including scFvs and other molecules comprising, or alternatively consisting of antibody fragments or variants of the invention). In one embodiment, a composition of the present invention comprises, one, two, three, four, five, or more antibodies that comprise or alternatively consist of, a polypeptide having an amino acid sequence of any one or more of the VH domains contained in SEQ ID NOS:1881–2128 as disclosed in Table 1, or a variant thereof. In another embodiment, a composition of the present invention comprises, one, two, three, four, five, or more antibodies that comprise, or alternatively consist of, a polypeptide having an amino acid sequence of any one or more of the VH CDR1s contained in SEQ ID NOS:1881–2128 as disclosed in Table 1, or a variant thereof. In another embodiment, a composition of the present invention comprises, one, two, three, four, five or more antibodies that comprise, or alternatively consist of, a polypeptide having an amino acid sequence of any one or more of the VH CDR2s contained in SEQ ID NOS:1881–2128 as disclosed in Table 1, or a variant thereof. In a preferred embodiment, a composition of the present invention comprises, one, two, three, four, five, or more antibodies that comprise, or alternatively consist of, a polypeptide having an amino acid sequence of any one or more of the VH CDR3s contained in SEQ ID NOS:1881–2128 as disclosed in Table 1 or a variant thereof.

The present invention further provides for compositions comprising, one or more antibodies (including scFvs, or molecules comprising, or alternatively consisting of antibody fragments or variants of the invention). In one embodiment, a composition of the present invention comprises, one, two, three, four, five, or more antibodies that comprise or alternatively consist of, a polypeptide having an amino acid sequence of any one or more of the VH domains contained in SEQ ID NOS:1–1562 as disclosed in Table 1, or a variant thereof. In another embodiment, a composition of the present invention comprises, one, two, three, four, five, or more antibodies that comprise, or alternatively consist of, a polypeptide having an amino acid sequence of any one or more of the VH CDR1s contained in SEQ ID NOS:1–1562 as disclosed in Table 1, or a variant thereof. In another embodiment, a composition of the present invention comprises, one, two, three, four, five or more antibodies that comprise, or alternatively consist of, a polypeptide having an amino acid sequence of any one or more of the VH CDR2s contained in SEQ ID NOS:1–1562 as disclosed in Table 1, or a variant thereof. In a preferred embodiment, a composition of the present invention comprises, one, two, three, four, five, or more antibodies that comprise, or alternatively consist of, a polypeptide having an amino acid sequence of any one or more of the VH CDR3s contained in SEQ ID NOS:1–1562 as disclosed in Table 1 or a variant thereof.

Other embodiments of the present invention providing for compositions comprising, one or more antibodies (including scFvs and other molecules comprising, or alternatively consisting of antibody fragments or variants of the invention) are listed below. In another embodiment, a composition of the present invention comprises, one, two, three, four, five, or more antibodies that comprise, or alternative consist of, a polypeptide having an amino acid sequence of any one or more of the VL domains contained in SEQ ID NOS: 1563–1880 as disclosed in Table 1, or a variant thereof. In another embodiment, a composition of the present invention comprises, one, two, three, four, five, or more antibodies that comprise, or alternatively consist of, a polypeptide having an amino acid sequence of any one or more of the VL CDR1 s contained in SEQ ID NOS:1563–1880 as disclosed in Table 1, or a variant thereof. In another embodiment, a composition of the present invention comprises, one, two, three, four, five, or more antibodies that comprise, or alternatively consist of, a polypeptide having an amino acid sequence of any one or more of the VL CDR2s contained SEQ ID NOS:1563–1880 as disclosed in Table 1, or a variant thereof. In a preferred embodiment, a composition of the present invention comprises, one, two, three, four, five, or more antibodies that comprise, or alternatively consist of, a polypeptide having an amino acid sequence of any one or more of the VL CDR3s contained in SEQ ID NOS:1563–1880 as disclosed in Table 1, or a variant thereof.

Other embodiments of the present invention providing for compositions comprising, one or more antibodies (including scFvs and other molecules comprising, or alternatively consisting of antibody fragments or variants of the invention) are listed below. In another embodiment, a composition of the present invention comprises, one, two, three, four, five, or more antibodies that comprise, or alternatively consist of, a polypeptide having an amino acid sequence of any one or more of the VL domains contained in SEQ ID NOS:1881–2128 as disclosed in Table 1, or a variant thereof. In another embodiment, a composition of the present invention comprises, one, two, three, four, five, or more antibodies that comprise, or alternatively consist of, a polypeptide having an amino acid sequence of any one or more of the VL CDR1 s contained in SEQ ID NOS:1881–2128 as disclosed in Table 1, or a variant thereof. In another embodiment, a composition of the present invention comprises, one, two, three, four, five, or more antibodies that comprise, or alternatively consist of, a polypeptide having an amino acid sequence of any one or more of the VL CDR2s SEQ ID NOS:1881–2128 as disclosed in Table 1, or a variant thereof. In a preferred embodiment, a composition of the present invention comprises, one, two, three, four, five, or more antibodies that comprise, or alternatively consist of, a polypeptide having an amino acid sequence of any one or more of the VL CDR3s contained in SEQ ID NOS:1881–2128 as disclosed in Table 1, or a variant thereof.

Other embodiments of the present invention providing for compositions comprising, one or more antibodies (including scFvs and other molecules comprising, or alternatively consisting of antibody fragments or variants of the invention) are listed below. In another embodiment, a composition of the present invention comprises, one, two, three, four, five, or more antibodies that comprise, or alternatively consist of, a polypeptide having an amino acid sequence of any one or more of the VL domains contained in SEQ ID NOS:1–1562 as disclosed in Table 1, or a variant thereof. In another embodiment, a composition of the present invention comprises, one, two, three, four, five, or more antibodies that comprise, or alternatively consist of, a polypeptide having an amino acid sequence of any one or more of the VL CDR1s contained in SEQ ID NOS:1–1562 as disclosed in Table 1, or a variant thereof. In another embodiment, a composition of the present invention comprises, one, two, three, four, five, or more antibodies that comprise, or alternatively consist of, a polypeptide having an amino acid sequence of any one or more of the VL CDR2s SEQ ID NOS:1–1562 as disclosed in Table 1, or a variant thereof. In a preferred embodiment, a composition of the present invention comprises, one, two, three, four, five, or more antibodies that comprise, or alternatively consist of, a polypeptide having an amino acid sequence of any one or more of the VL CDR3s contained in SEQ ID NOS:1–1562 as disclosed in Table 1, or a variant thereof.

In a preferred embodiment, a composition of the present invention comprises, one, two, three, four, five, or more antibodies that comprise, or alternatively consist of, a polypeptide having an amino acid sequence of any one or more of the VH domains in disclosed in Table 1, or a variant thereof, and an amino acid sequence of any one or more of the VL domains disclosed in Table 1, or a variant thereof wherein the VH and VL domains are from scFvs with the same specificity (i.e., from scFvs that bind soluble B Lymphocyte Stimulator (SEQ ID NOS:1563–1880), from scFvs that bind membrane-bound B Lymphocyte Stimulator (SEQ ID 1881–2128), or from scFvs that bind both soluble and membrane-bound B Lymphocyte Stimulator (SEQ ID NOS: 1–1562). In a preferred embodiment the invention provides antibodies wherein the VH CDRX (where X=1,2, or 3) and VL CDRY (where Y=1,2, or 3) are from scFvs with the same specificity (i.e., from scFvs that bind soluble B Lymphocyte Stimulator (SEQ ID NOS:1563–1880), from scFvs that bind membrane-bound B Lymphocyte Stimulator (SEQ ID NOS: 1881–2128), or from scFvs that bind both soluble and membrane-bound B Lymphocyte Stimulator (SEQ ID NOS: 1–1562). In yet another embodiment, a composition of the present invention comprises one or more fusion proteins.

As discussed in more detail below, a composition of the invention may be used either alone or in combination with other compositions. The antibodies (including scFvs and other molecules comprising, or alternatively consisting of antibody fragments or variants of the present invention) may further be recombinantly fused to a heterologous polypeptide at the N- or C-terminus or chemically conjugated (including covalently and non-covalently conjugations) to polypeptides or other compositions. For example, antibodies of the present invention may be recombinantly fused or conjugated to molecules useful as labels in detection assays and effector molecules such as heterologous polypeptides, drugs, radionuclides, or toxins. See, e.g., PCT publications WO 92/08495; WO 91/14438; WO 89/12624; U.S. Pat. No. 5,314,995; and EP 396,387.

Antibodies of the present invention (including scFvs and other molecules comprising, or alternatively consisting of antibody fragments or variants of the present invention) may be used, for example, but not limited to, to purify and detect B Lymphocyte Stimulator, and to target the polypeptides of the present invention to cells expressing membrane-bound B Lymphocyte Stimulator or B Lymphocyte Stimulator receptor, including both in vitro and in vivo diagnostic and therapeutic methods. For example, the antibodies have use in immunoassays for qualitatively and quantitatively measuring levels of B Lymphocyte Stimulator in biological samples. See, e.g., Harlow et al., Antibodies: A Laboratory Manual, (Cold Spring Harbor Laboratory Press, 2nd ed. 1988) (incorporated by reference herein in its entirety).

Methods Producing Antibodies

The antibodies of the invention (including scFvs and other molecules comprising, or alternatively consisting of antibody fragments or variants of the invention) can be produced by any method known in the art for the synthesis of antibodies, in particular, by chemical synthesis or preferably, by recombinant expression techniques.

The single chain Fvs disclosed in Table 1 were generated using phage display methods known in the art. Furthermore, other scFvs that immunospecifically bind B Lymphocyte Stimulator may be generated using phage display methods known in the art. In phage display methods, functional antibody domains are displayed on the surface of phage particles which carry the polynucleotide sequences encoding them. In particular, DNA sequences encoding VH and VL domains are amplified from animal cDNA libraries (e.g., human or murine cDNA libraries of lymphoid tissues) or synthetic cDNA libraries. The DNA encoding the VH and VL domains are joined together by an scFv linker by PCR and cloned into a phagemid vector (e.g., p CANTAB 6 or pComb 3 HSS). The vector is electroporated in *E. coli* and the *E. coli* is infected with helper phage. Phage used in these methods are typically filamentous phage including fd and M13 and the VH and VL domains are usually recombinantly fused to either the phage gene III or gene VIII. Phage expressing an antigen binding domain that binds to an antigen of interest (i.e., B Lymphocyte Stimulator or a fragment thereof) can be selected or identified with antigen, e.g., using labeled antigen or antigen bound or captured to a solid surface or bead. Examples of phage display methods that can be used to make the antibodies of the present invention include, but are not limited to, those disclosed in Brinkman et al., J. Immunol. Methods 182:41–50 (1995); Ames et al., J. Immunol. Methods 184:177–186 (1995); Kettleborough et al., Eur. J. Immunol. 24:952–958 (1994); Persic et al., Gene 187 9–18 (1997); Burton et al., Advances in Immunology 57:191–280(1994); PCT application No. PCT/GB91/O1134; PCT publications WO 90/02809; WO 91/10737; WO 92/01047; WO 92/18619; WO 93/11236; WO 95/15982; WO 95/20401; WO97/13844; and U.S. Pat. Nos. 5,698,426; 5,223,409; 5,403,484; 5,580,717; 5,427,908; 5,750,753; 5,821,047; 5,571,698; 5,427,908; 5,516,637; 5,780,225; 5,658,727; 5,733,743 and 5,969,108; each of which is incorporated herein by reference in its entirety.

As described in the above references, after phage selection, the antibody coding regions from the phage can be isolated and used to generate whole antibodies, including human antibodies, or any other desired antigen binding fragment, and expressed in any desired host, including mammalian cells, insect cells, plant cells, yeast, and bacteria, e.g., as described below. Techniques to recombinantly produce Fab, Fab' and F(ab')2 fragments can also be employed using methods known in the art such as those disclosed in PCT publication WO 92/22324; Mullinax et al., BioTechniques 12(6):864–869 (1992); Sawai et al., AJRI 34:26–34 (1995); and Better et al., Science 240:1041–1043 (1988) (said references incorporated by reference in their entireties).

To generate whole antibodies, PCR primers including VH or VL nucleotide sequences, a restriction site, and a flanking sequence to protect the restriction site can be used to amplify the VH or VL sequences in scFv clones. Utilizing cloning techniques known to those of skill in the art, the PCR amplified VH domains can be cloned into vectors expressing a VH constant region, e.g., the human gamma 4 constant region, and the PCR amplified VL domains can be cloned into vectors expressing a VL constant region, e.g., human kappa or lambda constant regions. Preferably, the vectors for expressing the VH or VL domains comprise a promoter suitable to direct expression of the heavy and light chains in the chosen expression system, a secretion signal, a cloning site for the immunoglobulin variable domain, immunoglobulin constant domains, and a selection marker such as neomycin. The VH and VL domains may also be cloned into one vector expressing the necessary constant regions. The heavy chain conversion vectors and light chain conversion vectors are then co-transfected into cell lines to generate stable or transient cell lines that express full-length antibodies, e.g., IgG, using techniques known to those of skill in the art.

Cell lines that express antibodies that comprise the VH and VL domains of scFvs of the invention have been deposited with the American Type Culture Collection ("ATCC™") on the dates listed in Table 2 and given the ATCC™ Deposit Numbers identified in Table 2. The American Type Culture Collectio is located at 10801 University Boulevard, Manassas, Va. 20110-2209, USA. The ATCC™ deposit was made pursuant to the terms of the Budapest Treaty on the international recognition of the deposit of microorganisms for purposes of patent procedure.

| Cell Line | Corresponding scFv | SEQ ID NO: | ATCC Deposit Number | ATCC Deposit Date |
|---|---|---|---|---|
| NSO-B11-15 | 1050B11-15 | 24 | PTA-3238 | Mar. 27, 2001 |
| NSO-anti-BLyS-6D08-18 | I006D08 | 2 | PTA-3239 | Mar. 27, 2001 |
| NSO- anti-BLyS-116A01-60 | 1116A01 | 327 | PTA-3240 | Mar. 27, 2001 |
| IO26C04K | I026C04-K | 1563 | PTA-3241 | Mar. 27, 2001 |
| IO50A12 | I050A12 | 12 | PTA-3242 | Mar. 27, 2001 |
| IO50-B11 | I050B11 | 9 | PTA-3243 | Mar. 27, 2001 |

Accordingly, in one embodiment, the invention provides antibodies that comprise the VH and VL domains of scFvs of the invention.

In a preferred embodiment, an antibody of the invention is the antibody expressed by cell line NSO-B11-15.

In a preferred embodiment, an antibody of the invention is the antibody expressed by cell line NSO-anti-BLyS-6D08-18.

In a preferred embodiment, an antibody of the invention is the antibody expressed by cell line NSO-anti-BLyS-116A01-60.

In a preferred embodiment, an antibody of the invention is the antibody expressed by cell line IO26C04K.

In a preferred embodiment, an antibody of the invention is the antibody expressed by cell line IO50A12.

In a preferred embodiment, an antibody of the invention is the antibody expressed by cell line NSO-B11.

In other preferred embodiments, the invention provides antibodies that competitively inhibit binding of an antibody comprising a fragment (e.g., VH domain, VL domain, VHCDR1, VHCDR2, VHCDR3, VLCDR1, VLCDR2, or VLCDR3) or variant of an scFv referred to in Table 1 to a B Lymphocyte Stimulator polypeptide. In preferred embodiments, the invention provides antibodies that which reduce the binding of an antibody comprising a fragment (e.g., VH domain, VL domain, VHCDR1, VHCDR2, VHCDR3, VLCDR1, VLCDR2, or VLCDR3) or variant of an scFv referred to in Table 1 to a B Lymphocyte Stimulator polypeptide by between 1% and 10% in a competitive inhibition assay. In preferred embodiments, the invention provides antibodies that which reduce the binding of an antibody comprising a fragment (e.g., VH domain, VL domain, VHCDR1, VHCDR2, VHCDR3, VLCDR1, VLCDR2, or VLCDR3) or variant of an scFv referred to in Table 1 to a B Lymphocyte Stimulator polypeptide by between 1% and 10% in a competitive inhibition assay.

In preferred embodiments, the invention provides antibodies that which reduce the binding of an antibody comprising a fragment (e.g., VH domain, VL domain, VHCDR1, VHCDR2, VHCDR3, VLCDR1, VLCDR2, or VLCDR3) or variant of an scFv referred to in Table 1 to a B Lymphocyte Stimulator polypeptide by at least 10% and up to 20% in a competitive inhibition assay.

In preferred embodiments, the invention provides antibodies that which reduce the binding of an antibody comprising a fragment (e.g., VH domain, VL domain, VHCDR1, VHCDR2, VHCDR3, VLCDR1, VLCDR2, or VLCDR3) or variant of an scFv referred to in Table 1 to a B Lymphocyte Stimulator polypeptide by at least 20% and up to 30% in a competitive inhibition assay.

In preferred embodiments, the invention provides antibodies that which reduce the binding of an antibody comprising a fragment (e.g., VH domain, VL domain, VHCDR1, VHCDR2, VHCDR3, VLCDR1, VLCDR2, or VLCDR3) or variant of an scFv referred to in Table 1 to a B Lymphocyte Stimulator polypeptide by at least 30% and up to 40% in a competitive inhibition assay.

In preferred embodiments, the invention provides antibodies that which reduce the binding of an antibody comprising a fragment (e.g., VH domain, VL domain, VHCDR1, VHCDR2, VHCDR3, VLCDR1, VLCDR2, or VLCDR3) or variant of an scFv referred to in Table 1 to a B Lymphocyte Stimulator polypeptide by at least 40% and up to 50% in a competitive inhibition assay.

In preferred embodiments, the invention provides antibodies that which reduce the binding of an antibody comprising a fragment (e.g., VH domain, VL domain, VHCDR1, VHCDR2, VHCDR3, VLCDR1, VLCDR2, or VLCDR3) or variant of an scFv referred to in Table 1 to a B Lymphocyte Stimulator polypeptide by at least 50% and up to 60% in a competitive inhibition assay.

In preferred embodiments, the invention provides antibodies that which reduce the binding of an antibody comprising a fragment (e.g., VH domain, VL domain, VHCDR1, VHCDR2, VHCDR3, VLCDR1, VLCDR2, or VLCDR3) or variant of an scFv referred to in Table 1 to a B Lymphocyte Stimulator polypeptide by at least 60% and up to 70% in a competitive inhibition assay.

In preferred embodiments, the invention provides antibodies that which reduce the binding of an antibody comprising a fragment (e.g., VH domain, VL domain, VHCDR1, VHCDR2, VHCDR3, VLCDR1, VLCDR2, or VLCDR3) or variant of an scFv referred to in Table 1 to a B Lymphocyte Stimulator polypeptide by at least 70% and up to 80% in a competitive inhibition assay.

In preferred embodiments, the invention provides antibodies that which reduce the binding of an antibody comprising a fragment (e.g., VH domain, VL domain, VHCDR1, VHCDR2, VHCDR3, VLCDR1, VLCDR2, or VLCDR3) or variant of an scFv referred to in Table 1 to a B Lymphocyte Stimulator polypeptide by at least 80% and up to 90% in a competitive inhibition assay.

In preferred embodiments, the invention provides antibodies that which reduce the binding of an antibody comprising a fragment (e.g., VH domain, VL domain, VHCDR1, VHCDR2, VHCDR3, VLCDR1, VLCDR2, or VLCDR3) or variant of an scFv referred to in Table 1 to a B Lymphocyte Stimulator polypeptide by at least 90% and up to 100% in a competitive inhibition assay.

In other preferred embodiments, the invention provides antibodies that competitively inhibit binding of the antibody produced by the cell line having ATCC™ deposit number PTA-3238 to a B Lymphocyte Stimulator polypeptide.

In other preferred embodiments, the invention provides antibodies that competitively inhibit binding of the antibody produced by the cell line having ATCC™ deposit number PTA-3239 to a B Lymphocyte Stimulator polypeptide.

In other preferred embodiments, the invention provides antibodies that competitively inhibit binding of the antibody produced by the cell line having ATCC™ deposit number PTA-3240 to a B Lymphocyte Stimulator polypeptide.

In other preferred embodiments, the invention provides antibodies that competitively inhibit binding of the antibody produced by the cell line having ATCC™ deposit number PTA-3241 to a B Lymphocyte Stimulator polypeptide.

In other preferred embodiments, the invention provides antibodies that competitively inhibit binding of the antibody produced by the cell line having ATCC™ deposit number PTA-3242 to a B Lymphocyte Stimulator polypeptide.

In other preferred embodiments, the invention provides antibodies that competitively inhibit binding of the antibody produced by the cell line having ATCC™ deposit number PTA-3243 to a B Lymphocyte Stimulator polypeptide.

For some uses, including in vivo use of antibodies in humans and in vitro detection assays, it may be preferable to use human or chimeric antibodies. Completely human antibodies are particularly desirable for therapeutic treatment of human patients. See also, U.S. Pat. Nos. 4,444,887 and 4,716,111; and PCT publications WO 98/46645, WO 98/50433, WO 98/24893, WO98/16654, WO 96/34096, WO 96/33735, and WO 91/10741; each of which is incorporated herein by reference in its entirety. In a specific embodiment, antibodies of the present invention comprise one or more VH and VL domains corresponding to the human scFvs of the invention and framework regions from another immunoglobulin molecule, preferably a human immunoglobulin molecule. In a specific embodiment, antibodies of the present invention comprise one or more CDRs corresponding to the human scFvs of the invention and framework regions from another immunoglobulin molecule, preferably a human immunoglobulin molecule. In other embodiments, an antibody of the present invention comprises one, two, three, four, five, six or more VL CDRs or VH CDRs corresponding to one or more of the human scFvs referred to in Table 1, or fragments or variants thereof, and framework regions (and, optionally CDRs not derived from the scFvs in Table 1) from a human immunoglobulin molecule. In a preferred embodiment, an antibody of the present invention comprises a VH CDR3, VL CDR3, or both, corresponding to the same scFv, or different scFvs referred to in Table 1, or fragments or variants thereof, and framework regions from a human immunoglobulin.

A chimeric antibody is a molecule in which different portions of the antibody are derived from different immunoglobulin molecules such as antibodies having a variable region derived from a human antibody and a non-human immunoglobulin constant region. Methods for producing chimeric antibodies are known in the art. See e.g., Morrison, Science 229:1202 (1985); Oi et al., BioTechniques 4:214 (1986); Gillies et al., J. Immunol. Methods 125:191–202 (1989); U.S. Pat. Nos. 5,807,715; 4,816,567; and 4,816,397, which are incorporated herein by reference in their entirety. Chimeric antibodies comprising one or more CDRs from human species and framework regions from a non-human immunoglobulin molecule (e.g., framework regions from a canine or feline immunoglobulin molecule) can be produced using a variety of techniques known in the art including, for example, CDR-grafting (EP 239,400; PCT publication WO 91/09967; U.S. Pat. Nos. 5,225,539; 5,530,101; and 5,585,089), veneering or resurfacing (EP 592,106; EP 519,596; Padlan, Molecular Immunology 28(4/5):489–498 (1991); Studnicka et al., Protein Engineering 7(6):805–814 (1994); Roguska et al., PNAS 91:969–973 (1994)), and chain shuffling (U.S. Pat. No. 5,565,332). In a preferred embodiment, chimeric antibodies comprise a human CDR3 having an amino acid sequence of any one of the VH CDR3s or VL CDR3s referred to in Table 1, or a variant thereof, and non-human framework regions or human framework regions different from those of the frameworks in the corresponding scFv disclosed in Table 1. Often, framework residues in the framework regions will be substituted with the corresponding residue from the CDR donor antibody to alter, preferably improve, antigen binding. These framework substitutions are identified by methods well known in the art, e.g., by modeling of the interactions of the CDR and framework residues to identify framework residues important for antigen binding and sequence comparison to identify unusual framework residues at particular positions. (See, e.g., Queen et al., U.S. Pat. No. 5,585,089; Riechmann et al., Nature 332:323 (1988), which are incorporated herein by reference in their entireties.)

Further, the antibodies of the invention can, in turn, be utilized to generate anti-idiotype antibodies that "mimic" B Lymphocyte Stimulator polypeptides using techniques well known to those skilled in the art. (See, e.g., Greenspan & Bona, FASEB J. 7(5):437–444 (1993); and Nissinoff, J. Immunol. 147(8):2429–2438 (1991)). For example, antibodies of the invention which bind to B Lymphocyte Stimulator and competitively inhibit the binding of B Lymphocyte Stimulator to its receptor (as determined by assays well known in the art such as, for example, that disclosed, infra) can be used to generate antiidiotypes that "mimic" a B Lymphocyte Stimulator ligand/receptor-binding domain and, as a consequence, bind to and neutralize B Lymphocyte Stimulator receptors (e.g., TACI, BCMA, and TR20). Such neutralizing anti-idiotypes (including molecules comprising, or alternatively consisting of, antibody fragments or variants, such as Fab fragments of such anti-idiotypes) can be used in therapeutic regimens to neutralize B Lymphocyte Stimulator. For example, such anti-idiotypic antibodies can be used to bind B Lymphocyte Stimulator ligands/receptors, and thereby block B Lymphocyte Stimulator mediated biological activity. Alternatively, anti-idiotypes that "mimic" a B Lymphocyte Stimulator binding domain may bind to B Lymphocyte Stimulator receptor(s) and induce B Lymphocyte Stimulator receptor mediated signalling (e.g., activation of nuclear factor of activated T cells (NF-AT), nuclear factor-kappa B (NF-kappa B), and/or AP-1). Such agonistic anti-idiotypes (including agonistic Fab fragments of these anti-idiotypes) can be used in therapeutic regimens to induce or enhance B Lymphocyte Stimulator receptor mediated signalling. For example, such anti-idiotypic antibodies can be used to bind B Lymphocyte Stimulator ligands/receptors, and thereby stimulate B Lymphocyte Stimulator mediated biological activity (e.g., B cell proliferation and/or immunoglobulin production).

Once an antibody molecule of the invention (including molecules comprising, or alternatively consisting of, antibody fragments or variants thereof) has been chemically synthesized or recombinantly expressed, it may be purified by any method known in the art for purification of an immunoglobulin molecule, or more generally, a protein molecule, such as, for example, by chromatography (e.g., ion exchange, affinity, particularly by affinity for the specific antigen after Protein A, and sizing column chromatography), centrifugation, differential solubility, or by any other standard technique for the purification of proteins. Further, the antibodies of the present invention may be fused to heterologous polypeptide sequences described herein or otherwise known in the art, to facilitate purification.

Polynucleotides Encoding an Antibody

The invention provides polynucleotides comprising, or alternatively consisting of, a nucleotide sequence encoding an antibody of the invention (including molecules comprising, or alternatively consisting of, antibody fragments or variants thereof). The invention also encompasses polynucleotides that hybridize under high stringency, or alternatively, under intermediate or lower stringency hybridization conditions, e.g., as defined supra, to polynucleotides complementary to nucleic acids having a polynucleotide sequence that encodes an antibody of the invention or a fragment or variant thereof.

The polynucleotides may be obtained, and the nucleotide sequence of the polynucleotides determined, by any method known in the art. Since the amino acid sequences of the scFv antibodies and VH domains, VL domains and CDRs thereof, are known (as described in Table 1), nucleotide sequences encoding these antibodies can be determined using methods well known in the art, i.e., the nucleotide codons known to encode the particular amino acids are assembled in such a way to generate a nucleic acid that encodes the antibody, of the invention. Such a polynucleotide encoding the antibody may be assembled from chemically synthesized oligonucleotides (e.g., as described in Kutmeier et al., BioTechniques 17:242 (1994)), which, briefly, involves the synthesis of overlapping oligonucleotides containing portions of the sequence encoding the antibody, annealing and ligating of those oligonucleotides, and then amplification of the ligated oligonucleotides by PCR.

Alternatively, a polynucleotide encoding an antibody (including molecules comprising, or alternatively consisting of, antibody fragments or variants thereof) may be generated from nucleic acid from a suitable source. If a clone containing a nucleic acid encoding a particular antibody is not available, but the sequence of the antibody molecule is known, a nucleic acid encoding the immunoglobulin may be chemically synthesized or obtained from a suitable source (e.g., an antibody cDNA library, or a cDNA library generated from, or nucleic acid, preferably poly A+ RNA, isolated from, any tissue or cells expressing the antibody, such as hybridoma cells selected to express an antibody of the invention) by PCR amplification using synthetic primers hybridizable to the 3' and 5' ends of the sequence or by cloning using an oligonucleotide probe specific for the particular gene sequence to identify, e.g., a cDNA clone from a cDNA library that encodes the antibody. Amplified nucleic acids generated by PCR may then be cloned into replicable cloning vectors using any method well known in the art.

Once the nucleotide sequence of the antibody (including molecules comprising, or alternatively consisting of, antibody fragments or variants thereof) is determined, the nucleotide sequence of the antibody may be manipulated using methods well known in the art for the manipulation of nucleotide sequences, e.g., recombinant DNA techniques, site directed mutagenesis, PCR, etc. (see, for example, the techniques described in Sambrook et al., 1990, Molecular Cloning, A Laboratory Manual, 2d Ed., Cold Spring Harbor Laboratory, Cold Spring Harbor, N.Y. and Ausubel et al., eds., 1998, Current Protocols in Molecular Biology, John Wiley & Sons, NY, which are both incorporated by reference herein in their entireties), to generate antibodies having a different amino acid sequence, for example to create amino acid substitutions, deletions, and/or insertions.

In a specific embodiment, one or more of the VH and VL domains referred to in Table 1, or fragments or variants thereof, is inserted within framework regions using recombinant DNA techniques known in the art. In a specific embodiment, one, two, three, four, five, six, or more of the CDRs referred to in Table 1, or fragments or variants thereof, is inserted within framework regions using recombinant DNA techniques known in the art. The framework regions may be naturally occurring or consensus framework regions, and preferably human framework regions (see, e.g., Chothia et al., J. Mol. Biol. 278: 457–479 (1998) for a listing of human framework regions, the contents of which are hereby incorporated by reference in its entirety). Preferably, the polynucleotides generated by the combination of the framework regions and CDRs encode an antibody (including molecules comprising, or alternatively consisting of, antibody fragments or variants thereof) that specifically binds to B Lymphocyte Stimulator. Preferably, as discussed supra, polynucleotides encoding variants of antibodies or antibody fragments having one or more amino acid substitutions may be made within the framework regions, and, preferably, the amino acid substitutions improve binding of the antibody to its antigen. Additionally, such methods may be used to make amino acid substitutions or deletions of one or more variable region cysteine residues participating in an intrachain disulfide bond to generate antibody molecules, or antibody fragments or variants, lacking one or more intrachain disulfide bonds. Other alterations to the polynucleotide are encompassed by the present invention and fall within the ordinary skill of the art.

Recombinant Expression of an Antibody

Recombinant expression of an antibody of the invention (including scFvs and other molecules comprising, or alternatively consisting of, antibody fragments or variants thereof (e.g., a heavy or light chain of an antibody of the invention or a portion thereof or a single chain antibody of the invention)), requires construction of an expression vector(s) containing a polynucleotide that encodes the antibody. Once a polynucleotide encoding an antibody molecule (e.g., a whole antibody, a heavy or light chain of an antibody, or portion thereof (preferably, but not necessarily, containing the heavy or light chain variable domain)), of the invention has been obtained, the vector(s) for the production of the antibody molecule may be produced by recombinant DNA technology using techniques well known in the art. Thus, methods for preparing a protein by expressing a polynucleotide containing an antibody encoding nucleotide sequence are described herein. Methods which are well known to those skilled in the art can be used to construct expression vectors containing antibody coding sequences and appropriate transcriptional and translational control signals. These methods include, for example, in vitro recombinant DNA techniques, synthetic techniques, and in vivo genetic recombination. The invention, thus, provides replicable vectors comprising a nucleotide sequence encoding an antibody molecule of the invention (e.g., a whole antibody, a heavy or light chain of an antibody, a heavy or light chain variable domain of an antibody, or a portion thereof, or a heavy or light chain CDR, a single chain Fv, or fragments or variants thereof), operably linked to a promoter. Such vectors may include the nucleotide sequence encoding the constant region of the antibody molecule (see, e.g., PCT Publication WO 86/05807; PCT Publication WO 89/01036; and U.S. Pat. No. 5,122,464, the contents of each of which are hereby incorporated by reference in its entirety) and the variable domain of the antibody may be cloned into such a vector for expression of the entire heavy chain, the entire light chain, or both the entire heavy and light chains.

The expression vector(s) is(are) transferred to a host cell by conventional techniques and the transfected cells are then cultured by conventional techniques to produce an antibody of the invention. Thus, the invention includes host cells containing polynucleotide(s) encoding an antibody of the invention (e.g., whole antibody, a heavy or light chain thereof, or portion thereof, or a single chain antibody of the invention, or a fragment or variant thereof), operably linked to a heterologous promoter. In preferred embodiments, for the expression of entire antibody molecules, vectors encoding both the heavy and light chains may be co-expressed in the host cell for expression of the entire immunoglobulin molecule, as detailed below.

A variety of host-expression vector systems may be utilized to express the antibody molecules of the invention. Such host-expression systems represent vehicles by which the coding sequences of interest may be produced and subsequently purified, but also represent cells which may, when transformed or transfected with the appropriate nucleotide coding sequences, express an antibody molecule of the invention in situ. These include, but are not limited to, microorganisms such as bacteria (e.g., *E. coli, B. subtilis*) transformed with recombinant bacteriophage DNA, plasmid DNA or cosmid DNA expression vectors containing antibody coding sequences; yeast (e.g., *Saccharomyces, Pichia*) transformed with recombinant yeast expression vectors containing antibody coding sequences; insect cell systems infected with recombinant virus expression vectors (e.g., baculovirus) containing antibody coding sequences; plant cell systems infected with recombinant virus expression vectors (e.g., cauliflower mosaic virus, CaMV; tobacco mosaic virus, TMV) or transformed with recombinant plasmid expression vectors (e.g., Ti plasmid) containing antibody coding sequences; or mammalian cell systems (e.g., COS, CHO, BHK, 293, 3T3 cells) harboring recombinant expression constructs containing promoters derived from the genome of mammalian cells (e.g., metallothionein promoter) or from mammalian viruses (e.g., the adenovirus late promoter; the vaccinia virus 7.5K promoter). Preferably, bacterial cells such as *Escherichia coli*, and more preferably, eukaryotic cells, especially for the expression of whole recombinant antibody molecule, are used for the expression of a recombinant antibody molecule. For example, mammalian cells such as Chinese hamster ovary cells (CHO), in conjunction with a vector such as the major intermediate early gene promoter element from human cytomegalovirus is an effective expression system for antibodies (Foecking et al., Gene 45:101 (1986); Cockett et al., Bio/Technology 8:2 (1990)).

In bacterial systems, a number of expression vectors may be advantageously selected depending upon the use intended for the antibody molecule being expressed. For example, when a large quantity of such a protein is to be produced, for the generation of pharmaceutical compositions of an antibody molecule, vectors which direct the expression of high levels of fusion protein products that are readily purified may be desirable. Such vectors include, but are not limited to, the *E. coli* expression vector pUR278 (Ruther et al., EMBO 1. 2:1791 (1983)), in which the antibody coding sequence may be ligated individually into the vector in frame with the lac Z coding region so that a fusion protein is produced; pIN vectors (Inouye & Inouye, Nucleic Acids Res. 13:3101–3109 (1985); Van Heeke & Schuster, J. Biol. Chem. 24:5503–5509 (1989)); and the like. pGEX vectors may also be used to express foreign polypeptides as fusion proteins with glutathione 5-transferase (GST). In general, such fusion proteins are soluble and can easily be purified from lysed cells by adsorption and binding to matrix glutathione agarose beads followed by elution in the presence of free glutathione. The pGEX vectors are designed to include thrombin or factor Xa protease cleavage sites so that the cloned target gene product can be released from the GST moiety.

In an insect system, *Autographa californica* nuclear polyhedrosis virus (AcNPV) may be used as a vector to express foreign genes. The virus grows in *Spodoptera frugiperda* cells. Antibody coding sequences may be cloned individually into non-essential regions (for example, the polyhedrin gene) of the virus and placed under control of an AcNPV promoter (for example, the polyhedrin promoter).

In mammalian host cells, a number of viral-based expression systems may be utilized. In cases where an adenovirus is used as an expression vector, the antibody coding sequence of interest may be ligated to an adenovirus transcription/translation control complex, e.g., the late promoter and tripartite leader sequence. This chimeric gene may then be inserted in the adenovirus genome by in vitro or in vivo recombination. Insertion in a non-essential region of the viral genome (e.g., region E1 or E3) will result in a recombinant virus that is viable and capable of expressing the antibody molecule in infected hosts (e.g., see Logan & Shenk, Proc. Natl. Acad. Sci. USA 8 1:355–359 (1984)). Specific initiation signals may also be required for efficient translation of inserted antibody coding sequences. These signals include the ATG initiation codon and adjacent sequences. Furthermore, the initiation codon must be in phase with the reading frame of the desired coding sequence to ensure translation of the entire insert. These exogenous translational control signals and initiation codons can be of a variety of origins, both natural and synthetic. The efficiency of expression may be enhanced by the inclusion of appropriate transcription enhancer elements, transcription terminators, etc. (see, e.g., Bittner et al., Methods in Enzymol. 153:51–544 (1987)).

In addition, a host cell strain may be chosen which modulates the expression of the inserted sequences, or modifies and processes the gene product in the specific fashion desired. Such modifications (e.g., glycosylation) and processing (e.g., cleavage) of protein products may be important for the function of the protein. Different host cells have characteristic and specific mechanisms for the post-translational processing and modification of proteins and gene products. Appropriate cell lines or host systems can be chosen to ensure the correct modification and processing of the foreign protein expressed. To this end, eukaryotic host cells which possess the cellular machinery for proper processing of the primary transcript, glycosylation, and phosphorylation of the gene product may be used. Such mammalian host cells include, but are not limited to, CHO, VERY, BHK, Hela, COS, NSO, MDCK, 293, 3T3, W138, and in particular, breast cancer cell lines such as, for example, BT483, Hs578T, HTB2, BT2O and T47D, and normal mammary gland cell line such as, for example, CRL7O3O and Hs578Bst.

For long-term, high-yield production of recombinant proteins, stable expression is preferred. For example, cell lines which stably express the antibody may be engineered. Rather than using expression vectors which contain viral origins of replication, host cells can be transformed with DNA controlled by appropriate expression control elements (e.g., promoter, enhancer, sequences, transcription terminators, polyadenylation sites, etc.), and a selectable marker. Following the introduction of the foreign DNA, engineered cells may be allowed to grow for 1–2 days in an enriched media, and then are switched to a selective media. The selectable marker in the recombinant plasmid confers resistance to the selection and allows cells to stably integrate the plasmid into their chromosomes and grow to form foci which in turn can be cloned and expanded into cell lines. This method may advantageously be used to engineer cell lines which express the antibody molecule. Such engineered cell lines may be particularly useful in screening and evaluation of compositions that interact directly or indirectly with the antibody molecule.

A number of selection systems may be used, including but not limited to, the herpes simplex virus thymidine kinase (Wigler et al., Cell 11:223 (1977)), hypoxanthineguanine phosphoribosyltransferase (Szybalska & Szybalski, Proc. Natl. Acad. Sci. USA 48:202 (1992)), and adenine phosphoribosyltransferase (Lowy et al., Cell 22:8 17 (1980)) genes can be employed in tk-, hgprt- or aprt-cells, respectively. Also, antimetabolite resistance can be used as the basis of selection for the following genes: dhfr, which confers resistance to methotrexate (Wigler et al., Natl. Acad. Sci. USA 77:357 (1980); O'Hare et al., Proc. Natl. Acad. Sci. USA 78:1527 (1981)); gpt, which confers resistance to mycophenolic acid (Mulligan & Berg, Proc. Natl. Acad. Sci. USA 78:2072 (1981)); neo, which confers resistance to the aminoglycoside G-418 (Clinical Pharmacy 12:488–505; Wu and Wu, Biotherapy 3:87–95 (1991); Tolstoshev, Ann. Rev. Pharmacol. Toxicol. 32:573–596 (1993); Mulligan, Science 260:926–932 (1993); and Morgan and Anderson, Ann. Rev. Biochem. 62:191–217 (1993); TIB TECH 11(5):155–215 (May, 1993)); and hygro, which confers resistance to hygromycin (Santerre et al., Gene 30:147 (1984)). Methods commonly known in the art of recombinant DNA technology may be routinely applied to select the desired recombinant clone, and such methods are described, for example, in Ausubel et al. (eds.), Current Protocols in Molecular Biology, John Wiley & Sons, NY (1993); Kriegler, Gene Transfer and Expression, A Laboratory Manual, Stockton Press, NY (1990); and in Chapters 12 and 13, Dracopoli et al. (eds), Current Protocols in Human Genetics, John Wiley & Sons, NY (1994); Colberre-Garapin et al., J. Mol. Biol. 150:1 (1981), which are incorporated by reference herein in their entireties.

The expression levels of an antibody molecule can be increased by vector amplification (for a review, see Bebbington and Hentschel, The use of vectors based on gene amplification for the expression of cloned genes in mammalian cells in DNA cloning, Vol. 3. (Academic Press, New York, 1987)). When a marker in the vector system expressing antibody is amplifiable, increase in the level of inhibitor present in culture of host cell will increase the number of copies of the marker gene. Since the amplified region is associated with the coding sequence of the antibody, production of the antibody will also increase (Crouse et al., Mol. Cell. Biol. 3:257 (1983)).

The host cell may be co-transfected with two expression vectors of the invention, the first vector encoding a heavy chain derived polypeptide and the second vector encoding a light chain derived polypeptide. The two vectors may contain identical selectable markers which enable equal expression of heavy and light chain polypeptides. Alternatively, a single vector may be used which encodes, and is capable of expressing, both heavy and light chain polypeptides. In such situations, the light chain is preferably placed before the heavy chain to avoid an excess of toxic free heavy chain (Proudfoot, Nature 322:52 (1986); Kohler, Proc. Natl. Acad. Sci. USA 77:2 197 (1980)). The coding sequences for the heavy and light chains may comprise cDNA or genomic DNA.

Once an antibody molecule of the invention has been produced by recombinant expression, it may be purified by any method known in the art for purification of an immunoglobulin molecule, or more generally, for purification of a protein, for example, by chromatography (e.g., ion exchange, affinity, particularly by affinity for the specific antigen after Protein A, and sizing column chromatography), centrifugation, differential solubility, or by any other standard technique for the purification of proteins. Further, the antibodies of the present invention may be fused to heterologous polypeptide sequences described herein or otherwise known in the art to facilitate purification.

Antibody Characterization

Antibodies of the present invention (including scFvs and other molecules comprising, or alternatively consisting of, antibody fragments or variants thereof) may be characterized in a variety of ways. In particular, antibodies and related molecules of the invention may be assayed for the ability to immunospecifically bind to B Lymphocyte Stimulator or a fragment of B Lymphocyte Stimulator (e.g., to the soluble form or the membrane-bound form of B Lymphocyte Stimulator) using techniques described herein or routinely modifying techniques known in the art. B Lymphocyte Stimulator or B Lymphocyte Stimulator fragments that may be immunospecifically bound by the compositions of the invention include, but are not limited to, human B Lymphocyte Stimulator (SEQ ID NOS:3228 and/or 3229) or B Lymphocyte Stimulator expressed on human monocytes; murine B Lymphocyte Stimulator (SEQ ID NOS:3230 and/or 3231) or B Lymphocyte Stimulator expressed on murine monocytes; rat B Lymphocyte Stimulator (either the soluble forms as given in SEQ ID NOS:3232, 3233, 3234 and/or 3235 or in a membrane associated form, e.g., on the surface of rat monocytes); or monkey B Lymphocyte Stimulator (e.g., the monkey B Lymphocyte Stimulator polypeptides of SEQ ID NOS:3236 and/or 3237, the soluble form of monkey B Lymphocyte Stimulator, or B Lymphocyte Stimulator expressed on monkey monocytes) or fragments thereof. Preferably compositions of the invention bind human B Lymphocyte Stimulator (SEQ ID NOS:3228 and/or 3229) or fragments thereof. Assays for the ability of the antibodies of the invention to immunospecifically bind B Lymphocyte Stimulator or a fragment of B Lymphocyte Stimulator may be performed in solution (e.g., Houghten, Bio/Techniques 13:412–421(1992)), on beads (e.g., Lam, Nature 354:82–84 (1991)), on chips (e.g., Fodor, Nature 364:555–556 (1993)), on bacteria (e.g., U.S. Pat. No. 5,223,409), on spores (e.g., U.S. Pat. Nos. 5,571,698; 5,403,484; and 5,223,409), on plasmids (e.g., Cull et al., Proc. Natl. Acad. Sci. USA 89:1865–1869 (1992)) or on phage (e.g., Scott and Smith, Science 249:386–390 (1990); Devlin, Science 249:404–406 (1990); Cwirla et al., Proc. Natl. Acad. Sci. USA 87:6378–6382 (1990); and Felici, J. Mol. Biol. 222:301–310 (1991)) (each of these references is incorporated herein in its entirety by reference). Antibodies that have been identified to immunospecifically bind to B Lymphocyte Stimulator or a fragment of B Lymphocyte Stimulator can then be assayed for their specificity and affinity for B Lymphocyte Stimulator or a fragment of B Lymphocyte Stimulator using or routinely modifying techniques described herein or otherwise known in the art.

The antibodies of the invention may be assayed for immunospecific binding to B Lymphocyte Stimulator and cross-reactivity with other antigens by any method known in the art. In particular, the ability of an antibody to immunospecifically bind to the soluble form or membrane-bound form of B Lymphocyte Stimulator and the specificity of the antibody, fragment, or variant for B Lymphocyte Stimulator polypeptide from a particular species (e.g., murine, monkey or human, preferably human) may be determined using or routinely modifying techniques described herein or otherwise known in art.

Immunoassays which can be used to analyze immunospecific binding and cross-reactivity include, but are not limited to, competitive and non-competitive assay systems using techniques such as western blots, radioimmunoassays, ELISA (enzyme linked immunosorbent assay), "sandwich" immunoassays, immunoprecipitation assays, precipitin reactions, gel diffusion precipitin reactions, immunodiffusion assays, agglutination assays, complement-fixation assays, immunoradiometric assays, fluorescent immunoassays, and protein A immunoassays, to name but a few. Such assays are routine and well known in the art (see, e.g., Ausubel et al, eds, 1994, Current Protocols in Molecular Biology, Vol. 1, John Wiley & Sons, Inc., New York, which is incorporated by reference herein in its entirety). Exemplary immunoassays are described briefly below (but are not intended by way of limitation).

Immunoprecipitation protocols generally comprise lysing a population of cells in a lysis buffer such as RIPA buffer (1% NP-40 or Triton X-100, 1% sodium deoxycholate, 0.1% SDS, 0.15 M NaCl, 0.01 M sodium phosphate at pH 7.2, 1% Trasylol) supplemented with protein phosphatase and/or protease inhibitors (e.g., EDTA, PMSF, aprotinin, sodium vanadate), adding the antibody of interest to the cell lysate, incubating for a period of time (e.g., 1 to 4 hours) at 40 degrees C., adding protein A and/or protein G sepharose beads to the cell lysate, incubating for about an hour or more at 40 degrees C., washing the beads in lysis buffer and resuspending the beads in SDS/sample buffer. The ability of the antibody of interest to immunoprecipitate a particular antigen can be assessed by, e.g., western blot analysis. One of skill in the art would be knowledgeable as to the parameters that can be modified to increase the binding of the antibody to an antigen and decrease the background (e.g., pre-clearing the cell lysate with sepharose beads). For further discussion regarding immunoprecipitation protocols see, e.g., Ausubel et al, eds, 1994, Current Protocols in Molecular Biology, Vol. 1, John Wiley & Sons, Inc., New York at 10.16.1.

Western blot analysis generally comprises preparing protein samples, electrophoresis of the protein samples in a polyacrylamide gel (e.g., 8%–20% SDS-PAGE depending on the molecular weight of the antigen), transferring the protein sample from the polyacrylamide gel to a membrane such as nitrocellulose, PVDF or nylon, blocking the membrane in blocking solution (e.g., PBS with 3% BSA or non-fat milk), washing the membrane in washing buffer (e.g., PBS-Tween 20), blocking the membrane with primary antibody (the antibody of interest) diluted in blocking buffer, washing the membrane in washing buffer, blocking the membrane with a secondary antibody (which recognizes the primary antibody, e.g., an anti-human antibody) conjugated to an enzymatic substrate (e.g., horseradish peroxidase or alkaline phosphatase) or radioactive molecule (e.g., $^{32}P$ or $^{125}I$) diluted in blocking buffer, washing the membrane in wash buffer, and detecting the presence of the antigen. One of skill in the art would be knowledgeable as to the parameters that can be modified to increase the signal detected and to reduce the background noise. For further discussion regarding western blot protocols see, e.g., Ausubel et al, eds, 1994, Current Protocols in Molecular Biology, Vol. 1, John Wiley & Sons, Inc., New York at 10.8.1.

ELISAs comprise preparing antigen, coating the well of a 96-well microtiter plate with the antigen, washing away antigen that did not bind the wells, adding the antibody of interest conjugated to a detectable compound such as an enzymatic substrate (e.g., horseradish peroxidase or alkaline phosphatase) to the wells and incubating for a period of time, washing away unbound antibodies or non-specifically bound antibodies, and detecting the presence of the antibodies specifically bound to the antigen coating the well. In ELISAs the antibody of interest does not have to be conjugated to a detectable compound; instead, a second antibody (which recognizes the antibody of interest) conjugated to a detectable compound may be added to the well. Further, instead of coating the well with the antigen, the antibody may be coated to the well. In this case, the detectable molecule could be the antigen conjugated to a detectable compound such as an enzymatic substrate (e.g., horseradish peroxidase or alkaline phosphatase). One of skill in the art would be knowledgeable as to the parameters that can be modified to increase the signal detected as well as other variations of ELISAs known in the art. For further discussion regarding ELISAs see, e.g., Ausubel et al, eds, 1994, Current Protocols in Molecular Biology, Vol. 1, John Wiley & Sons, Inc., New York at 11.2.1.

The binding affinity of an antibody (including an scFv or other molecule comprising, or alternatively consisting of, antibody fragments or variants thereof) to an antigen and the off-rate of an antibody-antigen interaction can be determined by competitive binding assays. One example of a competitive binding assay is a radioimmunoassay comprising the incubation of labeled antigen (e.g., $^{3}H$ or $^{125}I$) with the antibody of interest in the presence of increasing amounts of unlabeled antigen, and the detection of the antibody bound to the labeled antigen. The affinity of the antibody of the present invention for B Lymphocyte Stimulator and the binding off-rates can be determined from the data by Scatchard plot analysis. Competition with a second antibody can also be determined using radioimmunoassays. In this case, B Lymphocyte Stimulator is incubated with an antibody of the present invention conjugated to a labeled compound (e.g., $^{3}H$ or $^{125}I$) in the presence of increasing amounts of an unlabeled second anti-B Lymphocyte Stimulator antibody.

In a preferred embodiment, BIAcore kinetic analysis is used to determine the binding on and off rates of antibodies (including an scFv or other molecule comprising, or alternatively consisting of, antibody fragments or variants thereof) to B Lymphocyte Stimulator, or fragments of B Lymphocyte Stimulator. BIAcore kinetic analysis comprises analyzing the binding and dissociation of B Lymphocyte Stimulator from chips with immobilized antibodies on their surface as described in detail in Examples 6, 12, 17 and 18, infra.

The antibodies of the invention (including scFvs and other molecules comprising, or alternatively consisting of, antibody fragments or variants thereof) can also be assayed for their ability to inhibit, increase, or not significantly alter, the binding of B Lymphocyte Stimulator to a B Lymphocyte Stimulator receptor (e.g., TACI and BCMA) using techniques known to those of skill in the art. For example, cells expressing a receptor for B Lymphocyte Stimulator (e.g., IM9, REH, ARH-77cells, Namalwa, and RPMI-8226 B cell tumor lines as wells as peripheral CD20+ B cells) can be contacted with B Lymphocyte Stimulator in the presence or absence of an antibody, and the ability of the antibody to inhibit, increase, or not significantly alter, B Lymphocyte Stimulator binding to the cells can be measured. B Lymphocyte Stimulator binding to cells can be measured by, for example, flow cytometry or a scintillation assay. B Lymphocyte Stimulator or the antibody can be labeled with a detectable compound such as a radioactive label (e.g., $^{32}P$, $^{35}S$, and $^{125}I$) or a fluorescent label (e.g., fluorescein isothiocyanate, rhodamine, phycoerythrin, phycocyanin, allophycocyanin, o-phthaldehyde and fluorescamine) to enable detection of an interaction between B Lymphocyte Stimulator and a B Lymphocyte Stimulator receptor and/or B Lymphocyte Stimulator and an antibody of the invention. Alternatively, the ability of antibodies of the invention to inhibit, increase, or not significantly alter, B Lymphocyte Stimulator binding to a B Lymphocyte Stimulator receptor can be determined in cell-free assays. For example, native or recombinant B Lymphocyte Stimulator (e.g., that having the amino acid sequence of amino acids 134–285 of SEQ ID NO:3228) or a fragment thereof can be contacted with an antibody and the ability of the antibody to inhibit, increase, or not significantly alter, B Lymphocyte Stimulator from binding to a B Lymphocyte Stimulator receptor can be determined. Preferably, the antibody is immobilized on a solid support and B Lymphocyte Stimulator or a B Lymphocyte Stimulator fragment is labeled with a detectable compound. Alternatively, B Lymphocyte Stimulator or a B Lymphocyte Stimulator fragment is immobilized on a solid support and the antibody is labeled with a detectable compound. B Lymphocyte Stimulator may be partially or completely purified (e.g., partially or completely free of other polypeptides) or part of a cell lysate. Further, the B Lymphocyte Stimulator polypeptide may be a fusion protein comprising B Lymphocyte Stimulator or a biologically active portion thereof and a domain such as an Immunoglobulin Fc or glutathionine-5-transferase. For example, amino acid residues 1 –154 of TACI (GenBank accession number AAC51790), or 1–48 of BCMA (GenBank accession number NP_001183) may be fused to the Fc region of an IgG molecule and used in a cell free assay to determine the ability of antibodies of the invention to inhibit, increase, or not significantly alter, B Lymphocyte Stimulator binding to a B Lymphocyte Stimulator receptor. Alternatively, B Lymphocyte Stimulator can be biotinylated using techniques well known to those of skill in the art (e.g., biotinylation kit, Pierce Chemicals; Rockford, Ill.).

The antibodies of the invention (including scFvs or other molecules comprising, or alternatively consisting of, antibody fragments or variants thereof), can also be assayed for their ability to inhibit, stimulate, or not significantly alter, B Lymphocyte Stimulator-induced B-cell proliferation using techniques known to those of skill in the art. For example, B-cell proliferation can be assayed by $^3H$-thymidine incorporation assays and trypan blue cell counts (see, e.g., Moore et al., Science 285: 260–263 (1999)). Further, the antibodies of the invention, or fragments or variants thereof, can be assayed for their ability to block, stimulate, or not significantly alter, B Lymphocyte Stimulator-induced activation of cellular signaling molecules and transcription factors such as calcium-modulator and cyclophilin ligand ("CAML"), calcineurin, nuclear factor of activated T cells transcription factor ("NF-AT"), nuclear factor-kappa B ("NF-kappa B"), and AP-1 using techniques known to those of skill in the art (see, e.g., von Bulow and Bram, Science 278:138–141 (1997)). For example, NF-AT activity can be determined by electromobility gel shift assays, by detecting the expression of a protein known to be regulated by NF-AT (e.g., IL-2 expression), by detecting the induction of a reporter gene (e.g., an NF-AT regulatory element operably linked to a nucleic acid encoding a detectable marker such as luciferase, beta-galactosidase or chloramphenicol acetyltransferase (CAT)), or by detecting a cellular response (e.g., cellular differentiation, or cell proliferation).

The antibodies of the invention, or fragments or variants thereof can also be assayed for their ability to neutralize, enhance, or not significantly alter, B Lymphocyte Stimulator activity. For example, antibodies or fragments or variants thereof, may be routinely tested for their ability to inhibit B Lymphocyte Stimulator from binding to cells expressing the receptor for B Lymphocyte Stimulator (see Example 3, infra).

Selection and Screening for Antibodies that Immunospecifically Bind to Soluble B Lymphocyte Stimulator Antibodies of the invention (including scFvs and other molecules comprising, or alternatively consisting of, antibody fragments or variants thereof) may be screened in a variety of assays to identify those antibodies that immunospecifically bind to the soluble form of B Lymphocyte Stimulator. In one particular assay, antibodies that bind to the biotinylated soluble form of B Lymphocyte Stimulator in solution are captured on streptavidin coated magnetic beads. This assay may be relatively applied to identify antibodies of the invention that neutralize and/or bind to B Lymphocyte Stimulator. Additionally, antibodies may be assayed in neutralization assays described herein or otherwise known in the art (see Example 3, infra). For example, antibodies may be tested for their ability to inhibit soluble B Lymphocyte Stimulator (e.g., biotinylated B Lymphocyte Stimulator) from binding to IM9 cells. In this assay, labeled soluble B Lymphocyte Stimulator (e.g., biotinylated B Lymphocyte Stimulator) is incubated with candidate anti-B Lymphocyte Stimulator antibodies to allow for the formation of B Lymphocyte Stimulator-anti-B Lymphocyte Stimulator antibody complexes. Following incubation, an aliquot of the B Lymphocyte Stimulator-anti-B Lymphocyte Stimulator antibody sample is added to IM9 cells. The binding of soluble B Lymphocyte Stimulator may be determined using techniques known in the art. For example, the binding of biotinylated B Lymphocyte Stimulator to IM9 cells may be detected using a fluorimeter following the addition of streptavidin-delfia. Biotinylated B Lymphocyte Stimulator, if it is not bound by antibodies that neutralize B Lymphocyte Stimulator, binds to the cells is detected. Thus, an antibody that decreases the amount of bio-B Lymphocyte Stimulator that binds to IM-9 cells (relative to a control sample in which the B Lymphocyte Stimulator had been preincubated with an irrelevant antibody or no antibody at all) is identified as one that binds to and neutralizes the soluble form of B Lymphocyte Stimulator. In another assay, antibodies are screened using ELISAs for those antibodies that bind to biotinylated soluble B Lymphocyte Stimulator, but do not bind membrane-bound B Lymphocyte Stimulator, such as, for example, B Lymphocyte Stimulator on membranes from U937 cells (see Examples 2 and 9, infra). In these assays, soluble B Lymphocyte Stimulator (e.g., biotinylated B Lymphocyte Stimulator) and membrane-bound B Lymphocyte Stimulator (e.g., on U937 membranes) are incubated in separate samples with the same antibodies and those antibodies that bind to the soluble B Lymphocyte Stimulator (biotinylated B Lymphocyte Stimulator), but not membrane-bound B Lymphocyte Stimulator (e.g., on U937 membranes) are captured and identified.

Antibodies of the invention (including scFvs and other molecules comprising, or alternatively consisting of, antibody fragments or variants thereof) may be tested to identify those antibodies that do not cross-react with APRIL, endokine-alpha, VEGI, TRAIL, TNF-alpha, TNF-beta, Fas-L, LIGHT, and PBS (see Example 4, infra). Antibodies may also be tested for their affinity for B Lymphocyte Stimulator using, for example, BIAcore analysis (see Examples 6, 12, 17 and 18 infra). Antibodies may also be tested for their ability to stimulate, inhibit, or not alter, B Lymphocyte Stimulator-induced immunoglobulin production and/or B-cell proliferation using techniques known to those of skill in the art. For example, human B-cells, B Lymphocyte Stimulator and antibodies may be incubated together in 96 well plates and $^3$H-thymidine incorporation may be measured using a scintillation counter.

Selection and Screening for Antibodies that Immunospecifically Bind to Membrane-Bound B Lymphocyte Stimulator Antibodies of the invention (including scFvs and other molecules comprising, or alternatively consisting of, antibody fragments or variants thereof) may be screened in a variety of assays to identify those antibodies that immunospecifically bind to the membrane-bound form of B Lymphocyte Stimulator. In one particular assay, antibodies that bind to B Lymphocyte Stimulator on U937 membranes or immobilized histidine-tagged B Lymphocyte Stimulator are captured. Other cell lines that express B Lymphocyte Stimulator that might be useful for testing antibody binding to membrane-bound form of B Lymphocyte Stimulator include, K-562, HL-60 and THP-1 cells. In another assay, antibodies are screened using ELISAs for those antibodies (or antibody fragments or variants) that bind to B Lymphocyte Stimulator on U937 membranes or to histidine-tagged B Lymphocyte Stimulator. In this assay, antibodies are added to 96 well plates coated with U937 membranes or histidine-tagged B Lymphocyte Stimulator and those antibodies or antibody fragments or variants that bind to the U937 membranes or histidine-tagged B Lymphocyte Stimulator are captured. In another assay, antibodies are screened using ELISAs for those antibodies (or antibody fragments or variants thereof) that do not bind to biotinylated B Lymphocyte Stimulator (soluble B Lymphocyte Stimulator) but bind to membrane-bound B Lymphocyte Stimulator, such as, for example, that on membranes from U937 cells (see Example 2, infra). In these assays, soluble B Lymphocyte Stimulator (e.g., biotinylated B Lymphocyte Stimulator) and membrane-bound B Lymphocyte Stimulator (e.g., on U937 membranes) are incubated in separate samples with the same antibodies (or antibody fragments or variants) and those antibodies (or antibody fragments or variants) that do not bind to the soluble B Lymphocyte Stimulator (biotinylated B Lymphocyte Stimulator), but bind the membrane-bound B Lymphocyte Stimulator (e.g., on U937 membranes) are captured and identified. In other assays, antibodies are screened using ELISAs to determine which of the antibodies (or antibody fragments or variants) that bind to histidine-tagged B Lymphocyte Stimulator or membranes from U937 cells do not cross-react with APRIL, endokine-alpha, VEGI, TRAIL, TNF-alpha, TNF-beta, Fas-L, LIGHT, and PBS (See Example 4, infra). ELISAs can also be used to determine which of the antibodies (or antibody fragments or variants) that bind to histidine-tagged B Lymphocyte Stimulator or membranes from U937 cells bind to B Lymphocyte Stimulator in the presence of TNF-alpha (see Example 4, infra). Antibodies or fragments or variants thereof that immunospecifically bind to the membrane-bound form of B Lymphocyte Stimulator may also be tested for their affinity for histidine-tagged B Lymphocyte Stimulator using high-throughput BIAcore analysis (see Example 14, infra).

Additionally, antibodies of the invention may be screened against cells engineered to express an "uncleavable" form of B Lymphocyte Stimulator in order to determine their specificity for the membrane-bound form of B Lymphocyte Stimulator. Mutations in B Lymphocyte Stimulator which may achieve this result include, but are not limited to, the mutation or deletion of amino acid residues Lys-132 and/or Arg-133 of the B Lymphocyte Stimulator sequence shown in SEQ ID NO:3228. A typical mutagenesis might include mutation of one or both of residues Lys-132 or Arg-133 to alanine residues. Cells expressing such an "uncleavable" form of B Lymphocyte Stimulator provide a profound reagent to use in assaying the ability of antibodies to bind the membrane-bound form of B Lymphocyte Stimulator.

Selection and Screening for Antibodies that Immunospecifically Bind to Soluble and Membrane-Bound B Lymphocyte Stimulator Antibodies of the invention (including scFvs and other molecules comprising, or alternately consisting of, antibody fragments or variants) may be screened in a variety of assays to identify those antibodies or antibody fragments or variants that immunospecifically bind to the soluble form and membrane-bound form of B Lymphocyte Stimulator. In one particular assay, antibodies that bind to immobilized B Lymphocyte Stimulator are captured. In another assay, antibodies are screened using ELISAs for those antibodies (or antibody fragments or variants) that inhibit the binding of soluble B Lymphocyte Stimulator (e.g. soluble bio-B Lymphocyte Stimulator) to IM-9 cells as described supra. In other assays, antibodies are screened using ELISAs for those antibodies that bind to membranes from U937 cells. Additionally, further ELISA assays may be performed using techniques known in the art to determine which antibodies do not cross-react with APRIL, endokine-alpha, VEGI, TRAIL, TNF-alpha, TNF-beta, Fas-L, LIGHT, and PBS, or those antibodies that bind to B Lymphocyte Stimulator in the presence of TNF-alpha (see Example 4 infra). Antibodies may be assayed in neutralization assays using techniques described herein or otherwise known in the art. Antibodies that immunospecifically bind to the soluble and membrane-bound forms of B Lymphocyte Stimulator may also be tested for their affinity for B Lymphocyte Stimulator using high-throughput BIAcore analysis.

Antibody Conjugates

The present invention encompasses antibodies (including scFvs and other molecules comprising, or alternatively consisting of, antibody fragments or variants thereof), recombinantly fused or chemically conjugated (including both covalent and non-covalent conjugations) to a heterologous polypeptide (or portion thereof, preferably at least 10, at least 20, at least 30, at least 40, at least 50, at least 60, at least 70, at least 80, at least 90 or at least 100 amino acids of the polypeptide) to generate fusion proteins. The fusion does not necessarily need to be direct, but may occur through linker sequences. For example, antibodies of the invention may be used to target heterologous polypeptides to particular cell types (e.g., cells of monocytic lineage and B-cells), either in vitro or in vivo, by fusing or conjugating the heterologous polypeptides to antibodies of the invention that are specific for particular cell surface antigens (e.g., membrane-bound B Lymphocyte Stimulator on cells of monocytic lineage) or which bind antigens that bind particular cell surface receptors (e.g., TACI and/or BCMA located on B cells). Antibodies fused or conjugated to heterologous polypeptides may also be used in in vitro immunoassays and purification methods using methods known in the art. See e.g., Harbor et al., supra, and PCT publication WO 93/2 1232; EP 439,095; Naramura et al., Immunol. Lett. 39:91–99 (1994); U.S. Pat. No. 5,474,981; Gillies et al., PNAS 89:1428–1432 (1992); Fell et al., J. Immunol. 146:2446–2452 (1991), which are incorporated by reference in their entireties.

In one embodiment, a fusion protein comprises a polypeptide having an amino acid sequence of any one of the VH domains referred to in Table 1, and a heterologous polypeptide. In another embodiment, a fusion protein comprises a polypeptide having the amino acid sequence of any one of the VH CDR1s referred to in Table 1, and a heterologous polypeptide. In another embodiment, a fusion protein comprises a polypeptide having the amino acid sequence of any one of the VH CDR2s referred to in Table 1, and a heterologous polypeptide. In a preferred embodiment, a fusion protein comprises a polypeptide having the amino acid sequence of any one of the VH CDR3s referred to in Table 1 (i.e., SEQ ID NOS:2129–3227), and a heterologous polypeptide.

In another embodiment, a fusion protein comprises a polypeptide having the amino acid sequence of any one of the VL domains referred to in Table 1, and a heterologous polypeptide. In another embodiment, a fusion protein comprises a polypeptide having the amino acid sequence of any one of the VL CDR1s referred to in Table 1, and a heterologous polypeptide. In yet another embodiment, a fusion protein comprises a polypeptide having the amino acid sequence of any one of the VL CDR2s referred to in Table 1, and a heterologous polypeptide. In a preferred embodiment, a fusion protein comprises a polypeptide having the amino acid sequence of any one of the VL CDR3s referred to in Table 1, and a heterologous polypeptide.

In another embodiment, a fusion protein comprises a polypeptide having the amino acid sequence of any one of the VH domains referred to in Table 1, and one or more VL domains referred to in Table 1, and a heterologous polypeptide. In another embodiment, a fusion protein of the present invention comprises a polypeptide having the amino acid sequence of any one of the VH CDRs referred to in Table 1, and any one of the VL CDRs referred to in Table 1, and a heterologous polypeptide.

The present invention further includes compositions comprising, or alternatively consisting of, heterologous polypeptides fused or conjugated to antibody fragments. For example, the heterologous polypeptides may be fused or conjugated to a Fab fragment, Fd fragment, Fv fragment, $F(ab)_2$ fragment, or a portion thereof. Methods for fusing or conjugating polypeptides to antibody portions are known in the art. See, e.g., U.S. Pat. Nos. 5,336,603; 5,622,929; 5,359,046; 5,349,053; 5,447,851; 5,112,946; EP 307,434; EP 367,166; PCT publications WO 96/04388; WO 91/06570; Ashkenazi et al., Proc. Natl. Acad. Sci. USA 88: 10535–10539 (1991); Zheng et al., J. Immunol. 154:5590–5600 (1995); and Vil et al., Proc. Natl. Acad. Sci. USA 89:11337–11341 (1992) (said references incorporated by reference in their entireties).

Additional fusion proteins of the invention may be generated through the techniques of gene-shuffling, motif-shuffling, exon-shuffling, and/or codon-shuffling (collectively referred to as "DNA shuffling"). DNA shuffling may be employed to modulate the activities of antibodies (including scFvs and other molecules comprising, or alternatively consisting of, antibody fragments or variants thereof), such methods can be used to generate antibodies with altered activity (e.g., antibodies with higher affinities and lower dissociation rates). See, generally, U.S. Pat. Nos. 5,605,793; 5,811,238; 5,830,721; 5,834,252; and 5,837,458, and Patten et al., Curr. Opinion Biotechnol. 8:724–33 (1997); Harayama, Trends Biotechnol. 16(2):76–82 (1998); Hansson, et al., J. Mol. Biol. 287:265–76 (1999); and Lorenzo and Blasco, Biotechniques 24(2):308–13 (1998) (each of these patents and publications are hereby incorporated by reference in its entirety). In one embodiment, polynucleotides encoding antibodies of the invention may be altered by being subjected to random mutagenesis by error-prone PCR, random nucleotide insertion or other methods prior to recombination. In another embodiment, one or more portions of a polynucleotide encoding an antibody which portions immunospecifically bind to B Lymphocyte Stimulator may be recombined with one or more components, motifs, sections, parts, domains, fragments, etc. of one or more heterologous molecules.

Moreover, the antibodies of the present invention (including scFvs and other molecules comprising, or alternatively consisting of, antibody fragments or variants thereof), can be fused to marker sequences, such as a polypeptides to facilitate purification. In preferred embodiments, the marker amino acid sequence is a hexa-histidine polypeptide, such as the tag provided in a pQE vector (QIAGEN, Inc., 9259 Eton Avenue, Chatsworth, Calif., 91311), among others, many of which are commercially available. As described in Gentz et al., Proc. Natl. Acad. Sci. USA 86:821–824 (1989), for instance, hexa-histidine provides for convenient purification of the fusion protein. Other peptide tags useful for purification include, but are not limited to, the hemagglutinin "HA" tag, which corresponds to an epitope derived from the influenza hemagglutinin protein (Wilson et al., Cell 37:767 (1984)) and the "flag" tag (DYKDDDDK, (SEQ ID No: 3238) Stratagene, La Jolla, Calif.).

The present invention further encompasses antibodies (including scFvs and other molecules comprising, or alternatively consisting of, antibody fragments or variants thereof), conjugated to a diagnostic or therapeutic agent. The antibodies can be used diagnostically to, for example, monitor or prognose the development or progression of a tumor as part of a clinical testing procedure to, e.g., determine the efficacy of a given treatment regimen. Detection can be facilitated by coupling the antibody to a detectable substance. Examples of detectable substances include, but are not limited to, various enzymes, prosthetic groups, fluorescent materials, luminescent materials, bioluminescent materials, radioactive materials, positron emitting metals using various positron emission tomographies, and nonradioactive paramagnetic metal ions. The detectable substance may be coupled or conjugated either directly to the antibody or indirectly, through an intermediate (such as, for example, a linker known in the art) using techniques known in the art. See, for example, U.S. Pat. No. 4,741,900 for metal ions which can be conjugated to antibodies for use as diagnostics according to the present invention. Examples of suitable enzymes include, but are not limited to, horseradish peroxidase, alkaline phosphatase, beta-galactosidase, or acetylcholinesterase; examples of suitable prosthetic group complexes include, but are not limited to, streptavidin/biotin and avidin/biotin; examples of suitable fluorescent materials include, but are not limited to, umbelliferone, fluorescein, fluorescein isothiocyanate, rhodamine, dichlorotriazinylamine fluorescein, dansyl chloride or phycoerythrin; an example of a luminescent material includes, but is not limited to, luminol; examples of bioluminescent materials include, but are not limited to, luciferase, luciferin, and aequorin; and examples of suitable radioactive material include, but are not limited to, iodine ($^{131}I$, $^{125}I$, $^{123}I$, $^{121}I$), carbon ($^{14}C$), sulfur ($^{35}S$), tritium ($^{3}H$), indium ($^{115m}In$, $^{113m}In$, $^{112}In$, $^{111}In$), and technetium ($^{99}Tc$, $^{99m}Tc$), thallium ($^{201}Ti$), gallium ($^{68}Ga$, $^{67}Ga$), palladium ($^{103}Pd$), molybdenum ($^{99}Mo$), xenon ($^{133}Xe$), fluorine ($^{18}F$), $^{153}Sm$, $^{177}Lu$, $^{159}Gd$, $^{149}Pm$, $^{140}La$, $^{175}Yb$, $^{166}Ho$, $^{90}y$, $^{47}Sc$, $^{186}Re$, $^{188}Re$, $^{142}Pr$, $^{105}Ph$, $^{97}Ru$, $^{68}Ge$, $^{57}Co$, $^{65}Zn$, $^{85}Sr$, $^{32}P$, $^{153}Gd$, $^{169}Yb$, $^{51}Cr$, $^{54}Mn$, $^{75}Se$, $^{113}Sn$, and $^{117}Tin$.

Further, an antibody of the invention (including an scFv or other molecule comprising, or alternatively consisting of, antibody fragments or variants thereof), may be conjugated to a therapeutic moiety such as a cytotoxin, e.g., a cytostatic or cytocidal agent, a therapeutic agent or a radioactive metal ion, e.g., alpha-emitters such as, for example, $^{213}Bi$. In specific embodiments, antibodies of the invention are attached to macrocyclic chelators useful for conjugating radiometal ions, including but not limited to, $^{111}In$, $^{177}Lu$, $^{90}Y$, $^{166}Ho$, and $^{153}Sm$, to polypeptides. In preferred embodiments, the radiometal ion associated with the macrocyclic chelators attached to antibodies of the invention is $^{111}In$. In preferred embodiments, the radiometal ion associated with the macrocyclic chelators attached to antibodies of the invention is $^{90}Y$. In specific embodiments, the macrocyclic chelator is 1,4,7,10-tetraazacyclododecane-N,N',N'',N'''-tetraacetic acid (DOTA). In other specific embodiments, the DOTA is attached to the antibody of the invention via a linker molecule. Examples of linker molecules useful for conjugating DOTA to a polypeptide are commonly known in the art—see, for example, DeNardo et al., Clin Cancer Res. 4(10):2483–90, 1998; Peterson et al., Bioconjug. Chem. 10(4):553–7, 1999; and Zimmerman et al, Nucl. Med. Biol. 26(8):943–50, 1999 which are hereby incorporated by reference in their entirety.

A cytotoxin or cytotoxic agent includes any agent that is detrimental to cells and includes such molecules as small molecule toxins and enzymatically active toxins of bacterial, fungal, plant, or animal origin, or fragments thereof. Examples include, but are not limited to, paclitaxol, cytochalasin B, gramicidin D, ethidium bromide, emetine, mitomycin, etoposide (VP-16), tenoposide, vincristine, vinblastine, colchicin, doxorubicin, daunorubicin, dihydroxy anthracin dione, mitoxantrone, mithramycin, actinomycin D, 1-dehydrotestosterone, glucocorticoids, procaine, tetracaine, lidocaine, propranolol, thymidine kinase, endonuclease, RNAse, and puromycin and fragments, variants or homologs thereof. Therapeutic agents include, but are not limited to, antimetabolites (e.g., methotrexate, 6-mercaptopurine, 6-thioguanine, cytarabine, 5-fluorouracil decarbazine), alkylating agents (e.g., mechlorethamine, thioepa chlorambucil, melphalan, carmustine (BSNU) and lomustine (CCNU), cyclophosphamide, busulfan, dibromomannitol, streptozotocin, mitomycin C, and cisdichlorodiamine platinum (II) (DDP) cisplatin), anthracyclines (e.g., daunorubicin (formerly daunomycin) and doxorubicin), antibiotics (e.g., dactinomycin (formerly actinomycin), bleomycin, mithramycin, and anthramycin (AMC)), and anti-mitotic agents (e.g., vincristine and vinblastine), improsulfan, piposulfan, benzodopa, carboquone, meturedopa, uredopa, altretamine, triethylenemelamine, trietylenephosphoramide, triethylenethiophosphaoramide trimethylolomelamine, chlornaphazine, cholophosphamide, estramustine, ifosfamide, novembichin, phenesterine, prednimustine, trofosfamide, uracil mustard, chlorozotocin, fotemustine, nimustine, ranimustine, aclacinomysins, azaserine, cactinomycin, calicheamicin, carabicin, carminomycin, carzinophilin, chromomycins, detorubicin, 6-diazo-5-oxo-L-norleucine, epirubicin, esorubicin, idarubicin, marcellomycin, mycophenolic acid, nogalamycin, olivomycins, peplomycin, potfiromycin, quelamycin, rodorubicin, streptonigrin, tubercidin, ubenimex, zinostatin, zorubicin, denopterin, pteropterin, trimetrexate, fludarabine, thiamiprine, ancitabine, azacitidine, 6-azauridine, carmofur, dideoxyuridine, doxifluridine, enocitabine, floxuridine, 5-FU, calusterone, dromostanolone propionate, epitiostanol, mepitiostane, testolactone, aminoglutethimide, mitotane, trilostane, frolinic acid, aceglatone, aldophosphamide glycoside, aminolevulinic acid, amsacrine, bestrabucil, bisantrene, edatraxate, defofamine, dernecolcine, diaziquone, elformithine, elliptiniurn acetate, etoglucid, gallium nitrate, hydroxyurea, lentinan, lonidamine, mitoguazone, mopidamol, nitracrine, pentostatin, phenamet, pirarubicin, podophyllinic acid, 2-ethylhydrazide, procarbazine, PSKO, razoxane, sizofiran, spirogermanium, tenuazonic acid, triaziquone, 2, 2',2''-trichlorotriethylamine, urethan, vindesine, dacarbazine, mannomustine, mitobronitol, mitolactol, pipobroman, gacytosine, arabinoside ("Ara-C"), taxoids, e.g. paclitaxel (TAXOL", Bristol-Myers Squibb Oncology, Princeton, N.J.) doxetaxel (TAXOTERE", Rh6ne-Poulenc Rorer, Antony, France), gemcitabine, ifosfamide, vinorelbine, navelbine, novantrone, teniposide, aminopterin, xeloda, ibandronate, CPT-I 1, topoisomerase inhibitor RFS 2000, difluoromethylomithine (DMFO), retinoic acid, esperamicins, capecitabine, and pharmaceutically acceptable salts, acids or derivatives of any of the above. Also included in this definition are anti-hormonal agents that act to regulate or inhibit hormone action on tumors such as anti-estrogens including for example tamoxifen, raloxifene, aromatase inhibiting 4(5)-imidazoles, 4 hydroxytamoxifen, trioxifene, keoxifene, LY 117018, onapristone, toremifene (Fareston), and anti-androgens such as flutamide, nilutamide, bicalutamide, leuprolide, and goserelin, and pharmaceutically acceptable salts, acids or derivatives of any of the above.

Techniques known in the art may be applied to label antibodies of the invention. Such techniques include, but are not limited to, the use of bifunctional conjugating agents (see e.g., U.S. Pat. Nos. 5,756,065; 5,714,631; 5,696,239; 5,652,361; 5,505,931; 5,489,425; 5,435,990; 5,428,139; 5,342,604; 5,274,119; 4,994,560; and 5,808,003; the contents of each of which are hereby incorporated by reference in its entirety) and direct coupling reactions (e.g., Bolton-Hunter and Chloramine-T reaction).

The antibodies of the invention which are conjugates can be used for modifying a given biological response, the therapeutic agent or drug moiety is not to be construed as limited to classical chemical therapeutic agents. For example, the drug moiety may be a protein or polypeptide possessing a desired biological activity. Such proteins may include, but are not limited to, for example, a toxin such as abrin, ricin A, alpha toxin, pseudomonas exotoxin, or diphtheria toxin, saporin, momordin, gelonin, pokeweed antiviral protein, alpha-sarcin and cholera toxin; a protein such as tumor necrosis factor, alpha-interferon, beta-interferon, nerve growth factor, platelet derived growth factor, tissue plasminogen activator, an apoptotic agent, e.g., TNF-alpha, TNF-beta, AIM I (see, International Publication No. WO 97/33899), AIM II (see, International Publication No. WO 97/34911), Fas Ligand (Takahashi et al., *Int. Immunol.,* 6:1567–1574 (1994)), VEGI (see, International Publication No. WO 99/23105), a thrombotic agent or an anti-angiogenic agent, e.g., angiostatin or endostatin; or, biological response modifiers such as, for example, lymphokines, interleukin-1 (IL-1), interleukin-2 (IL-2), interleukin-6 (IL- 6), granulocyte macrophage colony stimulating factor (GM-CSF), granulocyte colony stimulating factor (G-CSF), or other growth factors.

Antibodies of the invention (including scFvs and other molecules comprising, or alternatively consisting of, antibody fragments or variants thereof), may also be attached to solid supports, which are particularly useful for immunoassays or purification of the target antigen. Such solid supports include, but are not limited to, glass, cellulose, polyacrylamide, nylon, polystyrene, polyvinyl chloride or polypropylene.

Techniques for conjugating a therapeutic moiety to antibodies are well known, see, e.g., Arnon et al., "Monoclonal Antibodies For Immunotargeting Of Drugs In Cancer Therapy", in Monoclonal Antibodies And Cancer Therapy, Reisfeld et al. (eds.), pp. 243–56 (Alan R. Liss, Inc. 1985); Hellstrom et al., "Antibodies For Drug Delivery", in Controlled Drug Delivery (2nd Ed.), Robinson et al. (eds.), pp. 623–53 (Marcel Dekker, Inc. 1987); Thorpe, "Antibody Carriers Of Cytotoxic Agents In Cancer Therapy: A Review", in Monoclonal Antibodies '84: Biological And Clinical Applications, Pinchera et al. (eds.), pp. 475–506 (1985); "Analysis, Results, And Future Prospective Of The Therapeutic Use Of Radiolabeled Antibody In Cancer Therapy", in Monoclonal Antibodies For Cancer Detection And Therapy, Baldwin et al. (eds.), pp. 303–16 (Academic Press 1985), and Thorpe et al., "The Preparation And Cytotoxic Properties Of Antibody-Toxin Conjugates", Immunol. Rev. 62:119–58 (1982).

Alternatively, an antibody of the invention can be conjugated to a second antibody to form an antibody heteroconjugate as described by Segal in U.S. Pat. No. 4,676,980, which is incorporated herein by reference in its entirety.

An antibody of the invention (including an scFv or and other molecule comprising, or alternatively consisting of, an antibody fragment or variant thereof), with or without a therapeutic moiety conjugated to it, administered alone or in combination with cytotoxic factor(s) and/or cytokine(s) can be used as a therapeutic.

Use of Antibodies for Epitope Mapping

The present invention provides antibodies (including scFvs and other molecules comprising, or alternatively consisting of, antibody fragments or variants thereof), that can be used to identify epitopes of B Lymphocyte Stimulator. In particular, the antibodies of the present invention can be used to identify epitopes of human B Lymphocyte Stimulator (SEQ ID NOS:3228 and/or 3229) or B Lymphocyte Stimulator expressed on human monocytes; murine B Lymphocyte Stimulator (SEQ ID NOS:3230 and/or 3231) or B Lymphocyte Stimulator expressed on murine monocytes; rat B Lymphocyte Stimulator (either the soluble forms as given in SEQ ID NOS:3232, 3233, 3234 and/or 3235 or in a membrane associated form, e.g., on the surface of rat monocytes); or monkey B Lymphocyte Stimulator (e.g., the monkey B Lymphocyte Stimulator polypeptides of SEQ ID NOS:3236 and/or 3237, the soluble form of monkey B Lymphocyte Stimulator, or B Lymphocyte Stimulator expressed on monkey monocytes) using techniques described herein or otherwise known in the art. Fragments which function as epitopes may be produced by any conventional means. (See, e.g., Houghten, Proc. Natl. Acad. Sci. USA 82:5131–5135 (1985), further described in U.S. Pat. No. 4,631,211.)

Diagnostic Uses of Antibodies

Labeled antibodies of the invention (including molecules comprising, or alternatively consisting of, antibody fragments or variants thereof) which specifically bind to B Lymphocyte Stimulator can be used for diagnostic purposes to detect, diagnose, prognose, or monitor diseases and/or disorders associated with the aberrant expression and/or activity of B Lymphocyte Stimulator or B Lymphocyte Stimulator receptor. The invention provides for the detection of aberrant expression of B Lymphocyte Stimulator comprising: (a) assaying the expression of B Lymphocyte Stimulator in a biological sample from an individual using one or more antibodies of the invention that immunospecifically binds to B Lymphocyte Stimulator; and (b) comparing the level of B Lymphocyte Stimulator with a standard level of B Lymphocyte Stimulator, e.g., in normal biological samples, whereby an increase or decrease in the assayed level of B Lymphocyte Stimulator compared to the standard level of B Lymphocyte Stimulator is indicative of aberrant expression.

By "biological sample" is intended any fluids and/or cells obtained from an individual, body fluid, body tissue, body cell, cell line, tissue culture, or other source which may contain B Lymphocyte Stimulator protein or mRNA. Body fluids include, but are not limited to, sera, plasma, urine, synovial fluid, spinal fluid, saliva, and mucous. Tissues samples may be taken from virtually any tissue in the body. Tissue samples may also be obtained from autopsy material. Methods for obtaining tissue biopsies and body fluids from mammals are well known in the art. Where the biological sample is to include mRNA, a tissue biopsy is the preferred source.

The invention also provides for the detection of aberrant expression of B Lymphocyte Stimulator receptor comprising (a) assaying the expression of B Lymphocyte Stimulator receptor in a biological sample from an individual using one or more antibodies or fragments or variants thereof that immunospecifically binds only to soluble B Lymphocyte Stimulator, but does not inhibit B Lymphocyte Stimulator /B Lymphocyte Stimulator receptor binding. Such an antibody, by way of an example that is not to be construed as limiting, would be one that is able to capture a biotinylated B Lymphocyte Stimulator from solution (see Example 8), but that would not prevent B Lymphocyte Stimulator from binding to IM-9 cells (see Example 3). and (b) comparing the level of B Lymphocyte Stimulator receptor with a standard level of B Lymphocyte Stimulator receptor, e.g., in normal tissue or cell samples, whereby an increase or decrease in the assayed level of B Lymphocyte Stimulator receptor compared to the standard level of B Lymphocyte Stimulator receptor is indicative of aberrant expression.

Antibodies of the invention (including molecules comprising, or alternatively consisting of, antibody fragments or variants thereof) which specifically bind to B Lymphocyte Stimulator can be used for diagnostic purposes to detect, diagnose, prognose, or monitor autoimmune disorders and/or immunodeficiencies, and/or diseases or conditions associated therewith. The invention provides for the detection of aberrant expression of B Lymphocyte Stimulator comprising: (a) assaying the expression of B Lymphocyte Stimulator in a biological sample from an individual using one or more antibodies of the invention that immunospecifically binds to B Lymphocyte Stimulator; and (b) comparing the level of B Lymphocyte Stimulator with a standard level of B Lymphocyte Stimulator, e.g., in normal biological samples, whereby an increase or decrease in the assayed level of B Lymphocyte Stimulator compared to the standard level of B Lymphocyte Stimulator is indicative of an autoimmune disorder or disease and/or an immunodeficiency. In specific embodiments, an increase in the assayed level of B Lymphocyte Stimulator is indicative of an autoimmune disorder or disease. In other specific embodiments, a decrease in the assayed level of B Lymphocyte Stimulator is indicative of an immunodeficiency.

Antibodies of the invention (including molecules comprising, or alternatively consisting of, antibody fragments or variants thereof) which specifically bind to B Lymphocyte Stimulator but, do not inhibit B Lymphocyte Stimulator/B Lymphocyte Stimulator receptor binding can be used for diagnostic purposes to detect, diagnose, prognose, or monitor autoimmune disorders and/or immunodeficiencies, and/or diseases or conditions associated therewith. The invention provides for the detection of aberrant expression of B Lymphocyte Stimulator receptor comprising: (a) assaying the expression of B Lymphocyte Stimulator receptor in a biological sample from an individual using one or more antibodies of the invention that immunospecifically binds to B Lymphocyte Stimulator; and (b) comparing the level of B Lymphocyte Stimulator receptor with a standard level of B Lymphocyte Stimulator receptor, e.g., in normal biological samples, whereby an increase or decrease in the assayed level of B Lymphocyte Stimulator receptor compared to the standard level of B Lymphocyte Stimulator receptor is indicative of an autoimmune disorder or disease and/or an immunodeficiency. In specific embodiments, an increase in the assayed level of B Lymphocyte Stimulator receptor is indicative of an autoimmune disorder or disease. In other specific embodiments, a decrease in the assayed level of B Lymphocyte Stimulator receptor is indicative of an immunodeficiency.

Autoimmune disorders, diseases, or conditions that may be detected, diagnosed, prognosed, or monitored using the antibodies of the invention include, but are not limited to, autoimmune hemolytic anemia, autoimmune neonatal thrombocytopenia, idiopathic thrombocytopenia purpura, autoimmune neutropenia, autoimmunocytopenia, hemolytic anemia, antiphospholipid syndrome, dermatitis, gluten-sensitive enteropathy, allergic encephalomyelitis, myocarditis, relapsing polychondritis, rheumatic heart disease, glomerulonephritis (e.g., IgA nephropathy), Multiple Sclerosis, Neuritis, Uveitis Ophthalmia, Polyendocrinopathies, Purpura (e.g., Henloch-Scoenlein purpura), Reiter's Disease, Stiff-Man Syndrome, Autoimmune Pulmonary Inflammation, myocarditis, IgA glomerulonephritis, dense deposit disease, rheumatic heart disease, Guillain-Barre Syndrome, diabetes mellitus (e.g. Type I diabetes mellitus or insulin dependent diabetes mellitis), juvenile onset diabetes, and autoimmune inflammatory eye, autoimmune thyroiditis, hypothyroidism (i.e., Hashimoto's thyroiditis, systemic lupus erhythematosus, discoid lupus, Goodpasture's syndrome, Pemphigus, Receptor autoimmunities such as, for example, (a) Graves' Disease, (b) Myasthenia Gravis, and (c) insulin resistance, autoimmune hemolytic anemia, autoimmune thrombocytopenic purpura, rheumatoid arthritis, schleroderma with anti-collagen antibodies, mixed connective tissue disease, polymyositis/dermatomyositis, pernicious anemia (Addison's disease), idiopathic Addison's disease, infertility, glomerulonephritis such as primary glomerulonephritis and IgA nephropathy, bullous pemphigoid, Sjögren's syndrome, diabetes millitus, and adrenergic drug resistance (including adrenergic drug resistance with asthma or cystic fibrosis), chronic active hepatitis, primary biliary cirrhosis, other endocrine gland failure, vitiligo, vasculitis, post-MI, cardiotomy syndrome, urticaria, atopic dermatitis, asthma, inflammatory myopathies, and other inflammatory, granulomatous, degenerative, and atrophic disorders and other disorders such as inflammatory skin diseases including psoriasis and sclerosis, responses associated with inflammatory bowel disease (such as Crohn's disease and ulcerative colitis), respiratory distress syndrome (including adult respiratory distress syndrome, ARDS), meningitis, encephalitis, colitis, allergic conditions such as eczema and other conditions involving infiltration of T cells and chronic inflammatory responses, atherosclerosis, leukocyte adhesion deficiency, Reynaud's syndrome, and immune responses associated with acute and delayed hypersensitivity mediated by cytokines and T-lymphocytes typically found in tuberculosis, sarcoidosis, granulomatosis and diseases involving leukocyte diapedesis, central nervous system (CNS) inflammatory disorder, multiple organ injury syndrome, antigen-antibody complex mediated diseases, anti-glomerular basement membrane disease, Lambert-Eaton myasthenic syndrome, Beheet disease, giant cell arteritis, immune complex nephritis, IgA nephropathy, IgM polyneuropathies or autoimmune thrombocytopenia etc.

In specific embodiments, the present invention encompasses methods and compositions for detecting, diagnosing and/or prognosing diseases or disorders associated with hypergammaglobulinemia (e.g., AIDS, autoimmune diseases, and some immunodeficiencies). In other specific embodiments, the present invention encompasses methods and compositions for detecting, diagnosing and/or prognosing diseases or disorders associated with hypogammaglobulinemia (e.g., an immunodeficiency).

Immunodeficiencies that may be detected, diagnosed, prognosed, or monitored using the antibodies of the invention include, but are not limited to, severe combined immunodeficiency (SCID)-X linked, SCID-autosomal, adenosine deaminase deficiency (ADA deficiency), X-linked agammaglobulinemia (XLA), Bruton's disease, congenital agammaglobulinemia, X-linked infantile agammaglobulinemia, acquired agammaglobulinemia, adult onset agammaglobulinemia, late-onset agammaglobulinemia, dysgammaglobulinemia, hypogammaglobulinemia, transient hypogammaglobulinemia of infancy, unspecified hypogammaglobulinemia, agammaglobulinemia, common variable immunodeficiency (CVID) (acquired), Wiskott-Aldrich Syndrome (WAS), X-linked immunodeficiency with hyper IgM, non X-linked immunodeficiency with hyper IgM, selective IgA deficiency, IgG subclass deficiency (with or without IgA deficiency), antibody deficiency with normal or elevated Igs, immunodeficiency with thymoma, Ig heavy chain deletions, kappa chain deficiency, B cell lymphoproliferative disorder (BLPD), selective IgM immunodeficiency, recessive agammaglobulinemia (Swiss type), reticular dysgenesis, neonatal neutropenia, severe congenital leukopenia, thymic alymphoplasia-aplasia or dysplasia with immunodeficiency, ataxia-telangiectasia, short limbed dwarfism, X-linked lymphoproliferative syndrome (XLP), Nezelof syndrome-combined immunodeficiency with Igs, purine nucleoside phosphorylase deficiency (PNP), MHC Class II deficiency (Bare Lymphocyte Syndrome) and severe combined immunodeficiency.

Elevated levels of soluble B Lymphocyte Stimulator have been observed in the serum of patients with Systemic Lupus Erythematosus (SLE). In comparing the sera of 150 SLE patients with that of 38 control individuals, it was found that most of the SLE patients had more than 5 ng/ml of serum B Lymphocyte Stimulator, more than 30% of SLE patients had levels greater than 10 ng/ml, and approximately 10% of SLE patients had serum B Lymphocyte Stimulator levels greater than 20 ng/ml. In contrast, the majority of normal controls had B Lymphocyte Stimulator levels less than 5 ng/ml, and less than 10% had levels higher than 10 ng/ml. The elevated levels of B Lymphocyte Stimulator protein in sera is present in the soluble form and has biologic activity as assayed by the ability to stimulate anti-IgM treated B cells in vitro. SLE patients with more than 15 ng/ml serum B Lymphocyte Stimulator were also found to have elevated levels of anti-dsDNA antibodies compared to both normal controls and SLE patients with less than 5 ng/ml of serum B Lymphocyte Stimulator. (unpublished data).

In addition the serum of two subgroups of patients which were positive for anti-nuclear antibodies (ANA+) but did not meet the formal requirements of the American College of Rheumatology (ACR) for classification of SLE were analyzed for B Lymphocyte Stimulator levels. The first subgroup of sera was ANA+ sera that came from patients who did not present with the clinical impression of SLE. This group had only slightly elevated levels of B Lymphocyte Stimulator (~9 ng/ml B Lymphocyte Stimulator). The second subgroup however, which was ANA+ sera from patients who presented with the clinical impression of SLE, had significantly increased B Lymphocyte Stimulator levels (~15 ng/ml). These results suggest that an elevated level of B Lymphocyte Stimulator precedes the formal fulfillment of the ACR criteria. The ACR criteria are described in Tan, E. M., et al, *Arthritis and Rheumatism* 25:1271–1277 (1982).

Thus in specific embodiments, antibodies of the invention which specifically bind to B Lymphocyte Stimulator can be used for diagnostic purposes to detect, diagnose, prognose, or monitor Systemic Lupus Erythematosus or conditions associated therewith. The invention provides for the detection of aberrant expression of B Lymphocyte Stimulator comprising: (a) assaying the expression of B Lymphocyte Stimulator in a biological sample of an individual using one or more antibodies of the invention that immunospecifically binds to B Lymphocyte Stimulator; and (b) comparing the level of B Lymphocyte Stimulator with a standard level of B Lymphocyte Stimulator, e.g., in normal biological samples, whereby an increase in the assayed level of B Lymphocyte Stimulator compared to the standard level of B Lymphocyte Stimulator is indicative of SLE.

In other specific embodiments, antibodies of the invention which specifically bind to B Lymphocyte Stimulator can be used for diagnostic purposes to detect, diagnose, prognose, or monitor IgA nephropathy or conditions associated therewith. The invention provides for the detection of aberrant expression of B Lymphocyte Stimulator comprising: (a) assaying the expression of B Lymphocyte Stimulator in a biological sample of an individual using one or more antibodies of the invention that immunospecifically binds to B Lymphocyte Stimulator; and (b) comparing the level of B Lymphocyte Stimulator with a standard level of B Lymphocyte Stimulator, e.g., in normal biological samples, whereby an increase in the assayed level of B Lymphocyte Stimulator compared to the standard level of B Lymphocyte Stimulator is indicative of IgA nephropathy.

In other specific embodiments, antibodies of the invention which specifically bind to B Lymphocyte Stimulator can be used for diagnostic purposes to detect, diagnose, prognose, or monitor Sjögren's Syndrome or conditions associated therewith. The invention provides for the detection of aberrant expression of B Lymphocyte Stimulator comprising: (a) assaying the expression of B Lymphocyte Stimulator in a biological sample of an individual using one or more antibodies of the invention that immunospecifically binds to B Lymphocyte Stimulator; and (b) comparing the level of B Lymphocyte Stimulator with a standard level of B Lymphocyte Stimulator, e.g., in normal biological samples, whereby an increase in the assayed level of B Lymphocyte Stimulator compared to the standard level of B Lymphocyte Stimulator is indicative of Sjögren's Syndrome.

In other specific embodiments, antibodies of the invention which specifically bind to B Lymphocyte Stimulator can be used for diagnostic purposes to detect, diagnose, prognose, or monitor HIV infection or conditions associated therewith (e.g. AIDS). The invention provides for the detection of aberrant expression of B Lymphocyte Stimulator comprising: (a) assaying the expression of B Lymphocyte Stimulator in a biological sample of an individual using one or more antibodies of the invention that immunospecifically binds to B Lymphocyte Stimulator; and (b) comparing the level of B Lymphocyte Stimulator with a standard level of B Lymphocyte Stimulator, e.g., in normal biological samples, whereby an increase in the assayed level of B Lymphocyte Stimulator compared to the standard level of B Lymphocyte Stimulator is indicative of HIV infection.

In other specific embodiments, antibodies of the invention which specifically bind to B Lymphocyte Stimulator can be used for diagnostic purposes to detect, diagnose, prognose, or monitor Myasthenia Gravis or conditions associated therewith. The invention provides for the detection of aberrant expression of B Lymphocyte Stimulator comprising: (a) assaying the expression of B Lymphocyte Stimulator in a biological sample of an individual using one or more antibodies of the invention that immunospecifically binds to B Lymphocyte Stimulator; and (b) comparing the level of B Lymphocyte Stimulator with a standard level of B Lymphocyte Stimulator, e.g., in normal biological samples, whereby an increase in the assayed level of B Lymphocyte Stimulator compared to the standard level of B Lymphocyte Stimulator is indicative of Myasthenia Gravis.

In other specific embodiments, antibodies of the invention which specifically bind to B Lymphocyte Stimulator can be used for diagnostic purposes to detect, diagnose, prognose, or monitor idiopathic thrombocytopenic purpura (ITP) or conditions associated therewith. The invention provides for the detection of aberrant expression of B Lymphocyte Stimulator comprising: (a) assaying the expression of B Lymphocyte Stimulator in a biological sample of an individual using one or more antibodies of the invention that immunospecifically binds to B Lymphocyte Stimulator; and (b) comparing the level of B Lymphocyte Stimulator with a standard level of B Lymphocyte Stimulator, e.g., in normal biological samples, whereby an increase in the assayed level of B Lymphocyte Stimulator compared to the standard level of B Lymphocyte Stimulator is indicative of idiopathic thrombocytopenic purpura (ITP).

In other specific embodiments, antibodies of the invention which specifically bind to B Lymphocyte Stimulator can be used for diagnostic purposes to detect, diagnose, prognose, or monitor hemolytic anemia or conditions associated therewith. The invention provides for the detection of aberrant expression of B Lymphocyte Stimulator comprising: (a) assaying the expression of B Lymphocyte Stimulator in a biological sample of an individual using one or more antibodies of the invention that immunospecifically binds to B Lymphocyte Stimulator; and (b) comparing the level of B Lymphocyte Stimulator with a standard level of B Lymphocyte Stimulator, e.g., in normal biological samples, whereby an increase in the assayed level of B Lymphocyte Stimulator compared to the standard level of B Lymphocyte Stimulator is indicative of hemolytic anemia.

In other specific embodiments, antibodies of the invention which specifically bind to B Lymphocyte Stimulator can be used for diagnostic purposes to detect, diagnose, prognose, or monitor thyroiditis or conditions associated therewith.

The invention provides for the detection of aberrant expression of B Lymphocyte Stimulator comprising: (a) assaying the expression of B Lymphocyte Stimulator in a biological sample of an individual using one or more antibodies of the invention that immunospecifically binds to B Lymphocyte Stimulator; and (b) comparing the level of B Lymphocyte Stimulator with a standard level of B Lymphocyte Stimulator, e.g., in normal biological samples, whereby an increase in the assayed level of B Lymphocyte Stimulator compared to the standard level of B Lymphocyte Stimulator is indicative of thyroiditis.

In other specific embodiments, antibodies of the invention which specifically bind to B Lymphocyte Stimulator can be used for diagnostic purposes to detect, diagnose, prognose, or monitor Goodpasture's syndrome or conditions associated therewith. The invention provides for the detection of aberrant expression of B Lymphocyte Stimulator comprising: (a) assaying the expression of B Lymphocyte Stimulator in a biological sample of an individual using one or more antibodies of the invention that immunospecifically binds to B Lymphocyte Stimulator; and (b) comparing the level of B Lymphocyte Stimulator with a standard level of B Lymphocyte Stimulator, e.g., in normal biological samples, whereby an increase in the assayed level of B Lymphocyte Stimulator compared to the standard level of B Lymphocyte Stimulator is indicative of Goodpasture's syndrome.

In other specific embodiments, antibodies of the invention which specifically bind to B Lymphocyte Stimulator can be used for diagnostic purposes to detect, diagnose, prognose, or monitor multiple sclerosis or conditions associated therewith. The invention provides for the detection of aberrant expression of B Lymphocyte Stimulator comprising: (a) assaying the expression of B Lymphocyte Stimulator in a biological sample of an individual using one or more antibodies of the invention that immunospecifically binds to B Lymphocyte Stimulator; and (b) comparing the level of B Lymphocyte Stimulator with a standard level of B Lymphocyte Stimulator, e.g., in normal biological samples, whereby an increase in the assayed level of B Lymphocyte Stimulator compared to the standard level of B Lymphocyte Stimulator is indicative of multiple sclerosis.

In additional embodiments, antibodies of the invention which specifically bind to B Lymphocyte Stimulator can be used for diagnostic purposes to detect, diagnose, prognose, or monitor Rheumatoid Arthritis. The invention provides for the detection of aberrant expression of B Lymphocyte Stimulator comprising: (a) assaying the expression of B Lymphocyte Stimulator in a biological sample (e.g., serum and synovial fluid) of an individual using one or more antibodies of the invention that immunospecifically binds to B Lymphocyte Stimulator; and (b) comparing the level of B Lymphocyte Stimulator with a standard level of B Lymphocyte Stimulator, e.g., in normal biological samples, whereby an increase in the assayed level of B Lymphocyte Stimulator compared to the standard level of B Lymphocyte Stimulator is indicative of Rheumatoid arthritis.

In additional embodiments, antibodies of the invention which specifically bind to B Lymphocyte Stimulator can be used for diagnostic purposes to detect, diagnose, prognose, or monitor an immune-based rheumatologic disease, (e.g., SLE, rheumatoid arthritis, CREST syndrome (a variant of scleroderma characterized by calcinosis, Raynaud's phenomenon, esophageal motility disorders, sclerodactyly, and telangiectasia.), Seronegative spondyloarthropathy (SpA), Polymyositis/dermatomyositis, Microscopic polyangiitis, Hepatitis C-associated arthritis, Takayasu's arteritis, and undifferentiated connective tissue disorder). The invention provides for the detection of aberrant expression of B Lymphocyte Stimulator comprising: (a) assaying the expression of B Lymphocyte Stimulator in a biological sample (e.g., serum and synovial fluid) of an individual using one or more antibodies of the invention that immunospecifically binds to B Lymphocyte Stimulator; and (b) comparing the level of B Lymphocyte Stimulator with a standard level of B Lymphocyte Stimulator, e.g., in normal biological samples, whereby an increase in the assayed level of B Lymphocyte Stimulator compared to the standard level of B Lymphocyte Stimulator is indicative of monitor an immune-based rheumatologic disease.

It has been observed, that serum B Lymphocyte Stimulator levels inversely correlate with nephrotic range proteinuria (>3 gm proteinuria in a 24 hour urine collection) using a sample of 71 SLE patients (p=0.019). Proteinuria was determined in 71 SLE patients within one month of phlebotomy for serum B Lymphocyte Stimulator determination. Serum B Lymphocyte Stimulator was classified as low, normal, or high based on the $5^{th}$ through $95^{th}$ percentiles for normal controls. Nephrotic-range proteinuria was inversely correlated with serum Neutrokine-alpha levels. Thus, in specific embodiments, serum levels of B Lymphocyte Stimulator (determined using one or more antibodies of the present invention) in individuals diagnosed with an immune based rheumatologic disease (e.g., SLE, rheumatoid arthritis, CREST syndrome (a variant of scleroderma characterized by calcinosis, Raynaud's phenomenon, esophageal motility disorders, sclerodactyly, and telangiectasia.), seronegative spondyloarthropathy (SpA), polymyositis/dermatomyositis, microscopic polyangiitis, hepatitis C-asociated arthritis, Takayasu's arteritis, and undifferentiated connective tissue disorder) may be used to determine, diagnose, prognose, or monitor the severity of certain aspects or symptoms of the disease, such as nephrotic-range proteinuria.

In another specific embodiment, antibodies of the invention are used to diagnose, prognose, treat, or prevent conditions associated with CVID, including, but not limited to, conditions associated with acute and recurring infections (e.g., pneumonia, bronchitis, sinusitis, otitis media, sepsis, meningitis, septic arthritis, and osteomyelitis), chronic lung disease, autoimmunity, granulomatous disease, lymphoma, cancers (e.g., cancers of the breast, stomach, colon, mouth, prostate, lung, vagina, ovary, skin, and melanin forming cells (i.e. melanoma), inflammatory bowel disease (e.g., Crohn's disease, ulcerative colitis, and ulcerative proctitis), malabsorption, Hodgkin's disease, and Waldenstrom's macroglobulinemia.

The invention provides a diagnostic assay for diagnosing or prognosing a disease or disorder, comprising: (a) assaying for the level of B Lymphocyte Stimulator in a biological sample of an individual using one or more antibodies of the invention that immunospecifically bind to B Lymphocyte Stimulator; and (b) comparing the level of B Lymphocyte Stimulator with a standard B Lymphocyte Stimulator level, e.g., in a biological sample from a patient without the disease or disorder, whereby an increase or decrease in the assayed B Lymphocyte Stimulator level compared to the standard level of B Lymphocyte Stimulator is indicative of a particular disease or disorder. With respect to cancer, the presence of a relatively high amount of B Lymphocyte Stimulator in biopsied tissue from an individual may indicate a predisposition for the development of the disease, or may provide a means for detecting the disease prior to the appearance of actual clinical symptoms. A more definitive diagnosis of this type may allow health professionals to employ preventative measures or aggressive treatment earlier thereby preventing the development or further progression of the cancer.

In specific embodiments, the presence of a relatively high amount of membrane-bound B Lymphocyte Stimulator in a biological sample is indicative of monocytic cell related leukemias or lymphomas, such as, for example acute myelogenous leukemia and/or the severity thereof.

In other specific embodiments, the presence of a relatively high amount of B Lymphocyte Stimulator receptor in a biological sample (as determined using antibodies of the invention that bind to soluble B Lymphocyte Stimulator, but do not inhibit B Lymphocyte Stimulator/B Lymphocyte Stimulator receptor binding) is indicative of B cell related leukemias or lymphomas (e.g., chronic lymphocytic leukemia, multiple myeloma, non-Hodgkin's lymphoma, and Hodgkin's disease), and/or the severity thereof.

In specific embodiments, the invention provides a diagnostic assay for diagnosing or prognosing Systemic Lupus Erythematosus, comprising: (a) assaying for the level of B Lymphocyte Stimulator in a biological sample of an individual using one or more antibodies of the invention that immunospecifically bind to B Lymphocyte Stimulator; and (b) comparing the level of B Lymphocyte Stimulator with a standard B Lymphocyte Stimulator level, e.g., in a biological sample from a patient without Systemic Lupus Erythematosus, whereby an increase in the assayed B Lymphocyte Stimulator level compared to the standard level of B Lymphocyte Stimulator is indicative of Systemic Lupus Erythematosus.

In specific embodiments, the invention provides a diagnostic assay for diagnosing or prognosing a Rheumatoid Arthritis, comprising: (a) assaying for the level of B Lymphocyte Stimulator in a biological sample of an individual using one or more antibodies of the invention that immunospecifically bind to B Lymphocyte Stimulator; and (b) comparing the level of B Lymphocyte Stimulator with a standard B Lymphocyte Stimulator level, e.g., in a biological sample from a patient without Rheumatoid Arthritis, whereby an increase or decrease in the assayed B Lymphocyte Stimulator level compared to the standard level of B Lymphocyte Stimulator is indicative of Rheumatoid Arthritis.

The invention provides a diagnostic assay for diagnosing or prognosing a disease or disorder, comprising: (a) assaying for the level of B Lymphocyte Stimulator receptor in cells or a tissue sample of an individual using one or more antibodies of the invention that immunospecifically binds only to soluble B Lymphocyte Stimulator, but does not neutralize B Lymphocyte Stimulator /B Lymphocyte Stimulator receptor binding; and (b) comparing the level of B Lymphocyte Stimulator receptor with a standard B Lymphocyte Stimulator receptor level, e.g., in a tissue sample from a patient without the disease or disorder, whereby an increase or decrease in the assayed B Lymphocyte Stimulator receptor level compared to the standard level of B Lymphocyte Stimulator receptor is indicative of a particular disease or disorder. With respect to cancer, the presence of a relatively high amount of B Lymphocyte Stimulator receptor in biopsied tissue from an individual may indicate a predisposition for the development of the disease, or may provide a means for detecting the disease prior to the appearance of actual clinical symptoms. A more definitive diagnosis of this type may allow health professionals to employ preventative measures or aggressive treatment earlier thereby preventing the development or further progression of the cancer.

Antibodies of the invention (including molecules comprising, or alternatively consisting of, antibody fragments or variants thereof) can be used to assay protein levels in a biological sample using classical immunohistological methods as described herein or as known to those of skill in the art (e.g., see Jalkanen, et al., J. Cell. Biol. 101:976–985 (1985); Jalkanen, et al., J. Cell. Biol. 105:3087–3096 (1987)). Other antibody-based methods useful for detecting protein gene expression include immunoassays, such as the enzyme linked immunosorbent assay (ELISA) and the radioimmunoassay (RIA). Suitable antibody assay labels are known in the art and include enzyme labels, such as, glucose oxidase, alkaline phosphatase, and horseradish peroxidase; radioisotopes, such as iodine ($^{121}I$, $^{123}I$, $^{125}I$, $^{131}I$), carbon ($^{14}C$), sulfur ($^{35}S$), tritium ($^{3}H$), indium ($^{111}In$, $^{112}In$, $^{113m}In$, $^{115m}In$), technetium ($^{99}Tc$, $^{99m}Tc$), thallium ($^{201}Ti$), gallium ($^{68}Ga$, $^{67}Ga$), palladium ($^{103}Pd$), molybdenum ($^{99}Mo$), xenon ($^{133}Xe$), fluorine ($^{18}F$), $^{153}Sm$, $^{177}Lu$, $^{159}Gd$, $^{149}$ Pm, $^{140}La$, $^{175}Yb$, $^{166}Ho$, $^{90}y$, $^{47}Sc$, $^{188}Re$, $^{188}Re$, $^{142}Pr$, $^{105}Rh$, and $^{97}Ru$; luminescent labels, such as luminol; and fluorescent labels, such as fluorescein and rhodamine, and biotin.

One aspect of the invention is the detection and diagnosis of a disease or disorder associated with aberrant expression of B Lymphocyte Stimulator or B Lymphocyte Stimulator receptor in an animal, preferably a mammal and most preferably a human. In one embodiment, diagnosis comprises: a) administering (for example, parenterally, subcutaneously, or intraperitoneally) to a subject an effective amount of a labeled antibody of the invention (including molecules comprising, or alternatively consisting of, antibody fragments or variants thereof) that immunospecifically binds to B Lymphocyte Stimulator; b) waiting for a time interval following the administering for permitting the labeled antibody to preferentially concentrate at sites in the subject where B Lymphocyte Stimulator is expressed (and for unbound labeled molecule to be cleared to background level); c) determining background level; and d) detecting the labeled antibody in the subject, such that detection of labeled antibody or fragment thereof above the background level and above or below the level observed in a person without the disease or disorder indicates that the subject has a particular disease or disorder associated with aberrant expression of B Lymphocyte Stimulator or B Lymphocyte Stimulator receptor. Background level can be determined by various methods including, comparing the amount of labeled molecule detected to a standard value previously determined for a particular system.

It will be understood in the art that the size of the subject and the imaging system used will determine the quantity of imaging moiety needed to produce diagnostic images. In the case of a radioisotope moiety, for a human subject, the quantity of radioactivity injected will normally range from about 5 to 20 millicuries of $^{99}Tc$. The labeled antibody will then preferentially accumulate at the location of cells which contain the specific protein. In vivo tumor imaging is described in S. W. Burchiel et al., "Immunopharmacokinetics of Radiolabeled Antibodies and Their Fragments." (Chapter 13 in Tumor Imaging: The Radiochemical Detection of Cancer, S. W. Burchiel and B. A. Rhodes, eds., Masson Publishing Inc. (1982).

Depending on several variables, including the type of label used and the mode of administration, the time interval following the administration for permitting the labeled molecule to preferentially concentrate at sites in the subject and for unbound labeled molecule to be cleared to background level is 6 to 48 hours or 6 to 24 hours or 6 to 12 hours. In another embodiment the time interval following administration is 5 to 20 days or 5 to 10 days.

In an embodiment, monitoring of the disease or disorder is carried out by repeating the method for diagnosing the disease or disorder, for example, one month after initial diagnosis, six months after initial diagnosis, one year after initial diagnosis, etc.

Presence of the labeled molecule can be detected in the patient using methods known in the art for in vivo scanning. These methods depend upon the type of label used. Skilled artisans will be able to determine the appropriate method for detecting a particular label. Methods and devices that may be used in the diagnostic methods of the invention include, but are not limited to, computed tomography (CT), whole body scan such as position emission tomography (PET), magnetic resonance imaging (MRI), and sonography.

In a specific embodiment, the molecule is labeled with a radioisotope and is detected in the patient using a radiation responsive surgical instrument (Thurston et al., U.S. Pat. No. 5,441,050). In another embodiment, the molecule is labeled with a fluorescent compound and is detected in the patient using a fluorescence responsive scanning instrument. In another embodiment, the molecule is labeled with a positron emitting metal and is detected in the patient using positron emission-tomography. In yet another embodiment, the molecule is labeled with a paramagnetic label and is detected in a patient using magnetic resonance imaging (MRI).

Immunophenotyping

The antibodies of the invention (including molecules comprising, or alternatively consisting of, antibody fragments or variants thereof) may be utilized for immunophenotyping of cell lines and biological samples by their B Lymphocyte Stimulator expression or B Lymphocyte Stimulator receptor expression. Various techniques can be utilized using antibodies, fragments, or variants of the invention to screen for cellular populations (i.e., immune cells, particularly monocytic cells or B-cells) expressing B Lymphocyte Stimulator or B Lymphocyte Stimulator receptor, and include magnetic separation using antibody-coated magnetic beads, "panning" with antibody attached to a solid matrix (i.e., plate), and flow cytometry (see, e.g., U.S. Pat. No. 5,985,660; and Morrison et al., Cell, 96:737–49 (1999)).

These techniques allow for the screening of particular populations of cells, such as might be found with hematological malignancies (i.e., minimal residual disease (MRD) in acute leukemic patients) and "non-self" cells in transplantations to prevent Graft-versus-Host Disease (GVHD). Alternatively, these techniques allow for the screening of hematopoietic stem and progenitor cells capable of undergoing proliferation and/or differentiation, as might be found in human umbilical cord blood.

In one embodiment, antibodies of the invention (including molecules comprising, or alternatively consisting of, antibody fragments or variants thereof) are used to identify cells of monocytic or B cell origin.

Therapeutic Uses of Antibodies

The present invention is further directed to antibody-based therapies which involve administering antibodies of the invention (including molecules comprising, or alternatively consisting of, antibody fragments or variants thereof) to an animal, preferably a mammal, and most preferably a human, patient for treating one or more of the disclosed diseases, disorders, or conditions. Therapeutic compounds of the invention include, but are not limited to, antibodies of the invention and nucleic acids encoding antibodies (and anti-idiotypic antibodies) of the invention as described herein. The antibodies of the invention can be used to treat, ameliorate or prevent diseases, disorders or conditions associated with aberrant expression and/or activity of B Lymphocyte Stimulator or B Lymphocyte Stimulator receptor, including, but not limited to, any one or more of the diseases, disorders, or conditions described herein. The treatment and/or prevention of diseases, disorders, or conditions associated with aberrant B Lymphocyte Stimulator expression and/or activity or aberrant B Lymphocyte Stimulator receptor expression and/or activity includes, but is not limited to, alleviating symptoms associated with those diseases, disorders or conditions. Antibodies of the invention may be provided in pharmaceutically acceptable compositions as known in the art or as described herein.

Antibodies of the present invention (including molecules comprising, or alternatively consisting of, antibody fragments or variants thereof) that function as agonists or antagonists of B Lymphocyte Stimulator, preferably of B Lymphocyte Stimulator-induced signal transduction, can be administered to an animal to treat, prevent or ameliorate a disease or disorder associated with aberrant B Lymphocyte Stimulator expression, lack of B Lymphocyte Stimulator function, aberrant B Lymphocyte Stimulator receptor expression, or lack of B Lymphocyte Stimulator receptor function. For example, antibodies of the invention which disrupt the interaction between B Lymphocyte Stimulator and its receptor may be administered to an animal to treat, prevent or ameliorate a disease or disorder associated with aberrant B Lymphocyte Stimulator expression, excessive B Lymphocyte Stimulator function, aberrant B Lymphocyte Stimulator receptor expression, or excessive of B Lymphocyte Stimulator receptor function. Antibodies of the invention which do not prevent B Lymphocyte Stimulator from binding its receptor but inhibit or downregulate B Lymphocyte Stimulator-induced signal transduction can be administered to an animal to treat, prevent or ameliorate a disease or disorder associated with aberrant B Lymphocyte Stimulator expression, excessive B Lymphocyte Stimulator function, aberrant B Lymphocyte Stimulator receptor expression, or excessive B Lymphocyte Stimulator receptor function. In particular, antibodies of the present invention which prevent B Lymphocyte Stimulator-induced signal transduction by specifically recognizing the unbound B Lymphocyte Stimulator, receptor-bound B Lymphocyte Stimulator or both unbound and receptor-bound B Lymphocyte Stimulator can be administered to an animal to treat, prevent or ameliorate a disease or disorder associated with aberrant B Lymphocyte Stimulator expression, excessive B Lymphocyte Stimulator function, aberrant B Lymphocyte Stimulator receptor expression, or excessive B Lymphocyte Stimulator receptor function. The ability of an antibody of the invention to inhibit or downregulate B Lymphocyte Stimulator-induced signal transduction may be determined by techniques described herein or otherwise known in the art. For example, B Lymphocyte Stimulator-induced receptor activation and the activation of signaling molecules can be determined by detecting the phosphorylation (e.g., tyrosine or serine/threonine) of the receptor or a signaling molecule by immunoprecipitation followed by western blot analysis (for example, as described herein).

In a specific embodiment, an antibody of the present invention (including molecules comprising, or alternatively consisting of, antibody fragments or variants thereof) that inhibits or downregulates B Lymphocyte Stimulator activity by at least 95%, at least 90%, at least 85%, at least 80%, at least 75%, at least 70%, at least 60%, at least 50%, at least 45%, at least 40%, at least 45%, at least 35%, at least 30%, at least 25%, at least 20%, or at least 10% relative to B Lymphocyte Stimulator activity in absence of the antibody is administered to an animal to treat, prevent or ameliorate a disease or disorder associated with aberrant B Lymphocyte Stimulator expression, excessive B Lymphocyte Stimulator function, aberrant B Lymphocyte Stimulator receptor expression, or excessive B Lymphocyte Stimulator receptor function. In another embodiment, a combination of antibodies, a combination of antibody fragments, a combination of antibody variants, or a combination of antibodies, antibody fragments, and/or variants that inhibit or downregulate B Lymphocyte Stimulator activity by at least 95%, at least 90%, at least 85%, at least 80%, at least 75%, at least 70%, at least 65%, at least 60%, at least 55%, at least 50%, at least 45%, at least 40%, at least 45%, at least 35%, at least 30%, at least 25%, at least 20%, or at least 10% relative to B Lymphocyte Stimulator activity in absence of said antibodies, antibody fragments, and/or antibody variants are administered to an animal to treat, prevent or ameliorate a disease or disorder associated with aberrant B Lymphocyte Stimulator expression, excessive B Lymphocyte Stimulator function, aberrant B Lymphocyte Stimulator receptor expression, or excessive B Lymphocyte Stimulator receptor function.

Further, antibodies of the present invention (including molecules comprising, or alternatively consisting of, antibody fragments or variants thereof) which activate B Lymphocyte Stimulator-induced signal transduction can be administered to an animal to treat, prevent or ameliorate a disease or disorder associated with aberrant B Lymphocyte Stimulator expression, lack of B Lymphocyte Stimulator function, aberrant B Lymphocyte Stimulator receptor expression, or lack of B Lymphocyte Stimulator receptor function. These antibodies may potentiate or activate either all or a subset of the biological activities of B Lymphocyte Stimulator-mediated receptor activation, for example, by inducing multimerization of B Lymphocyte Stimulator and/or multimerization of the receptor. The antibodies of the invention may be administered with or without being precomplexed with B Lymphocyte Stimulator. In a specific embodiment, an antibody of the present invention that increases B Lymphocyte Stimulator activity by at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 99% relative to B Lymphocyte Stimulator activity in absence of the antibody is administered to an animal to treat, prevent or ameliorate a disease or disorder associated with aberrant B Lymphocyte Stimulator expression, lack of B Lymphocyte Stimulator function, aberrant B Lymphocyte Stimulator receptor expression, or lack of B Lymphocyte Stimulator receptor function. In another embodiment, a combination of antibodies, a combination of antibody fragments, a combination of antibody variants, or a combination of antibodies, antibody fragments and/or antibody variants that increase B Lymphocyte Stimulator activity by at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 99% relative to B Lymphocyte Stimulator activity in absence of the said antibodies or antibody fragments and/or antibody variants is administered to an animal to treat, prevent or ameliorate a disease or disorder associated with aberrant B Lymphocyte Stimulator expression or lack of B Lymphocyte Stimulator function or aberrant B Lymphocyte Stimulator receptor expression or lack of B Lymphocyte Stimulator receptor function.

One or more antibodies of the present invention (including molecules comprising, or alternatively consisting of, antibody fragments or variants thereof) that immunospecifically bind to B Lymphocyte Stimulator may be used locally or systemically in the body as a therapeutic. The antibodies of this invention (including molecules comprising, or alternatively consisting of, antibody fragments or variants thereof) may also be advantageously utilized in combination with other monoclonal or chimeric antibodies, or with lymphokines or hematopoietic growth factors (such as, e.g., IL-2, IL-3 and IL-7), for example, which serve to increase the number or activity of effector cells which interact with the antibodies.

The antibodies of the invention (including molecules comprising, or alternatively consisting of, antibody fragments or variants thereof) may be administered alone or in combination with other types of treatments (e.g., radiation therapy, chemotherapy, hormonal therapy, immunotherapy, anti-tumor agents, anti-angiogenesis and anti-inflammatory agents). Generally, administration of products of a species origin or species reactivity (in the case of antibodies) that is the same species as that of the patient is preferred. Thus, in a preferred embodiment, human antibodies, fragments, or variants, (e.g., derivatives), or nucleic acids, are administered to a human patient for therapy or prophylaxis.

It is preferred to use high affinity and/or potent in vivo inhibiting and/or neutralizing antibodies of the invention (including molecules comprising, or alternatively consisting of, antibody fragments or variants thereof) that immunospecifically bind to B Lymphocyte Stimulator, or polynucleotides encoding antibodies that immunospecifically bind to B Lymphocyte Stimulator, for both immunoassays directed to and therapy of disorders related to B Lymphocyte Stimulator polynucleotides or polypeptides, including fragments thereof. Such antibodies will preferably have an affinity for B Lymphocyte Stimulator and/or B Lymphocyte Stimulator fragments. Preferred binding affinities include those with a dissociation constant or $K_D$ less than or equal to $5\times10^{-2}$ M, $10^{-2}$ M, $5\times10^{-3}$ M, $10^{-3}$ M, $5\times10^{-4}$ M, $10^{-4}$ M, $5\times10^{-5}$ M, or $10^{-5}$ M. More preferably, antibodies of the invention bind B Lymphocyte Stimulator polypeptides or fragments or variants thereof with a dissociation constant or $K_D$ less than or equal to $5\times10^{-6}$ M, $10^{-6}$ M, $5\times10^{-7}$ M, $10^{-7}$ M, $5\times10^{-8}$ M, or $10^{-8}$ M. Even more preferably, antibodies of the invention bind B Lymphocyte Stimulator polypeptides or fragments or variants thereof with a dissociation constant or $K_D$ less than or equal to $5\times10^{-9}$ M, $10^{-9}$ M, $5\times10^{-10}$ M, $10^{-10}$ M, $5\times10^{-11}$ M, $10^{-11}$ M, $5\times10^{-12}$ M, $10^{-12}$ M, $5\times^{-13}$ M, $10^{-13}$ M, $5\times10^{-14}$ M, $10^{-14}$ M, $5\times10^{-15}$ M, or $10^{-15}$ M. The invention encompasses antibodies that bind B Lymphocyte Stimulator polypeptides with a dissociation constant or $K_D$ that is within any one of the ranges that are between each of the individual recited values.

In a preferred embodiment, antibodies of the invention neutralize B Lymphocyte Stimulator activity. In another preferred embodiment, antibodies of the invention inhibit B cell proliferation.

In a preferred embodiment, antibodies of the invention (including molecules comprising, or alternatively consisting of, antibody fragments or variants thereof) inhibit or reduce binding of the soluble form of B Lymphocyte Stimulator to a B Lymphocyte Stimulator receptor. In another preferred embodiment antibodies of the invention inhibit or reduce B cell proliferation induced by the soluble form of B Lymphocyte Stimulator. In another preferred embodiment antibodies of the invention inhibit or reduce immunoglobulin production induced by the soluble form of B Lymphocyte Stimulator.

In a preferred embodiment, antibodies of the invention (including molecules comprising, or alternatively consisting of, antibody fragments or variants thereof) inhibit or reduce binding of membrane-bound B Lymphocyte Stimulator to a B Lymphocyte Stimulator receptor. In another preferred embodiment, antibodies of the invention inhibit or reduce B cell proliferation induced by the membrane-bound form of B Lymphocyte Stimulator. In another preferred embodiment, antibodies of the invention inhibit or reduce immunoglobulin production induced by the membrane bound form of B Lymphocyte Stimulator.

In a preferred embodiment, antibodies of the invention (including molecules comprising, or alternatively consisting of, antibody fragments or variants thereof) inhibit or reduce binding of both the soluble and membrane-bound forms of B Lymphocyte Stimulator to a B Lymphocyte Stimulator receptor. In another preferred embodiment, antibodies of the invention inhibit or reduce B cell proliferation induced by either or both forms of B Lymphocyte Stimulator. In another preferred embodiment, antibodies of the invention inhibit or reduce immunoglobulin production induced by either or both forms of B Lymphocyte Stimulator.

In one embodiment, the invention provides a method of delivering antibody conjugates of the invention to targeted cells, such as, for example, monocytic cells expressing the membrane-bound form of B Lymphocyte Stimulator, or B cells expressing a B Lymphocyte Stimulator receptor.

In one embodiment, the invention provides a method for the specific delivery of antibodies and antibody conjugates of the invention to cells by administering molecules of the invention that are associated with heterologous polypeptides or nucleic acids. In one example, the invention provides a method for delivering a therapeutic protein into the targeted cell. In another example, the invention provides a method for delivering a single stranded nucleic acid (e.g., antisense or ribozymes) or double stranded nucleic acid (e.g., DNA that can integrate into the cell's genome or replicate episomally and that can be transcribed) into the targeted cell.

In another embodiment, the invention provides a method for the specific destruction of cells (e.g., the destruction of tumor cells) by administering antibodies or antibody conjugates of the invention (e.g., antibodies conjugated with radioisotopes, toxins, or cytotoxic prodrugs). In a specific embodiment, the invention provides a method for the specific destruction of cells of monocytic lineage (e.g., monocytic cell related leukemias or lymphomas, such as, for example acute myelogenous leukemia) by administering antibodies or antibody conjugates of the invention (e.g., antibodies conjugated with radioisotopes, toxins, or cytotoxic prodrugs) that immunospecifically bind the membrane-bound form of B Lymphocyte Stimulator. In another specific embodiment, the invention provides a method for the specific destruction of cells of B cell lineage (e.g., B cell related leukemias or lymphomas (e.g., chronic lymphocytic leukemia, multiple myeloma, non-Hodgkin's lymphoma, and Hodgkin's disease) by administering antibodies or antibody conjugates of the invention (e.g., antibodies conjugated with radioisotopes, toxins, or cytotoxic prodrugs) that bind soluble B Lymphocyte Stimulator, but do not inhibit B Lymphocyte Stimulator binding to a B Lymphocyte Stimulator receptor on B cells.

In another preferred embodiment antibodies of the invention (including antibody fragments and variants) promote or enhance B cell proliferation induced by the soluble form of B Lymphocyte Stimulator. In another preferred embodiment, antibodies of the invention (including antibody fragments and variants) promote or enhance B cell proliferation induced by the membrane or soluble form of APRIL. In another preferred embodiment antibodies of the invention (including antibody fragments and variants) increase or enhance immunoglobulin production induced by the soluble form of B Lymphocyte Stimulator. In another preferred embodiment antibodies of the invention (including antibody fragments and variants) increase or enhance immunoglobulin production induced by the membrane bound or soluble form of APRIL. In another preferred embodiment antibodies of the invention (including antibody fragments and variants) increase or enhance immunoglobulin production in response to T cell dependent immunogens. In another preferred embodiment antibodies of the invention (including antibody fragments and variants, and anti-antibody antibodies) increase or enhance immunoglobulin production in response to T cell independent immunogens.

In another embodiment, therapeutic or pharmaceutical compositions of the invention are administered to an animal to treat, prevent or ameliorate immune disorders. Immune disorders include, but are not limited to, autoimmune disorders (e.g., arthritis, graft rejection, Hashimoto's thyroiditis, insulin-dependent diabetes, lupus, idiopathic thrombocytopenic purpura, systemic lupus erythrematosus and multiple sclerosis), elective IgA deficiency, ataxia-telangiectasia, common variable immunodeficiency (CVID), X-linked agammaglobulinemia, severe combined immunodeficiency (SCID), Wiskott-Aldrich syndrome, idiopathic hyper-eosinophilic syndrome, monocytic leukemoid reaction, monocytic leukocytosis, monocytic leukopenia, monocytopenia, monocytosis, and graft or transplant rejection.

As discussed herein, antibodies and antibody compositions of the invention, may be used to treat, prevent, ameliorate, diagnose or prognose various immune system-related disorders and/or conditions associated with these disorders, in mammals, preferably humans. Many autoimmune disorders result from inappropriate recognition of self as foreign material by immune cells. This inappropriate recognition results in an immune response leading to the destruction of the host tissue. Therefore, the administration of antibody and antibody compositions of the invention that can inhibit an immune response, particularly the proliferation of B cells and/or the production of immunoglobulins, may be an effective therapy in treating and/or preventing autoimmune disorders. Thus, in preferred embodiments, antibodies and antibody compositions of the invention are used to treat, prevent, ameliorate, diagnose and/or prognose an autoimmune disorder, or condition(s) associated with such disorder.

Autoimmune disorders and conditions associated with these disorders that may be treated, prevented, ameliorated, diagnosed and/or prognosed with the therapeutic and pharmaceutical compositions of the invention include, but are not limited to, autoimmune hemolytic anemia, autoimmune neonatal thrombocytopenia, idiopathic thrombocytopenia purpura, autoimmune neutropenia, autoimmunocytopenia, hemolytic anemia, antiphospholipid syndrome, dermatitis, gluten-sensitive enteropathy, allergic encephalomyelitis, myocarditis, relapsing polychondritis, rheumatic heart disease, glomerulonephritis (e.g., IgA nephropathy), Multiple Sclerosis, Neuritis, Uveitis Ophthalmia, Polyendocrinopathies, Purpura (e.g., Henloch-Scoenlein purpura), Reiter's Disease, Stiff-Man Syndrome, Autoimmune Pulmonary Inflammation, myocarditis, IgA glomerulonephritis, dense deposit disease, rheumatic heart disease, Guillain-Barre Syndrome, insulin dependent diabetes mellitis, and autoimmune inflammatory eye disease.

Additional autoimmune disorders and conditions associated with these disorders that may be treated, prevented, ameliorated, diagnosed and/or prognosed with the therapeutic and pharmaceutical compositions of the invention include, but are not limited to, autoimmune thyroiditis, hypothyroidism (i.e., Hashimoto's thyroiditis) (often characterized, e.g., by cell-mediated and humoral thyroid cytotoxicity), systemic lupus erhythematosus (often characterized, e.g., by circulating and locally generated immune complexes), discoid lupus, Goodpasture's syndrome (often characterized, e.g., by anti-basement membrane antibodies), Pemphigus (often characterized, e.g., by epidermal acantholytic antibodies), Receptor autoimmunities such as, for example, (a) Graves' Disease (often characterized, e.g., by TSH receptor antibodies), (b) Myasthenia Gravis (often characterized, e.g., by acetylcholine receptor antibodies), and (c) insulin resistance (often characterized, e.g., by insulin receptor antibodies), autoimmune hemolytic anemia (often characterized, e.g., by phagocytosis of antibody-sensitized RBCs), autoimmune thrombocytopenic purpura (often characterized, e.g., by phagocytosis of antibody-sensitized platelets.

Additional autoimmune disorders and conditions associated with these disorders that may be treated, prevented, ameliorated, diagnosed and/or prognosed with the therapeutic and pharmaceutical compositions of the invention include, but are not limited to, rheumatoid arthritis (often characterized, e.g., by immune complexes in joints), schleroderma with anti-collagen antibodies (often characterized, e.g., by nucleolar and other nuclear antibodies), mixed connective tissue disease (often characterized, e.g., by antibodies to extractable nuclear antigens (e.g., ribonucleoprotein)), polymyositis/dermatomyositis (often characterized, e.g., by nonhistone ANA), pernicious anemia (often characterized, e.g., by antiparietal cell, microsomes, and intrinsic factor antibodies), idiopathic Addison's disease (often characterized, e.g., by humoral and cell-mediated adrenal cytotoxicity, infertility (often characterized, e.g., by antispermatozoal antibodies), glomerulonephritis (often characterized, e.g., by glomerular basement membrane antibodies or immune complexes) such as primary glomerulonephritis and IgA nephropathy, bullous pemphigoid (often characterized, e.g., by IgG and complement in basement membrane), Sjögren's syndrome (often characterized, e.g., by multiple tissue antibodies, and/or a specific nonhistone ANA (SS-B)), diabetes millitus (often characterized, e.g., by cell-mediated and humoral islet cell antibodies), and adrenergic drug resistance (including adrenergic drug resistance with asthma or cystic fibrosis) (often characterized, e.g., by beta-adrenergic receptor antibodies), chronic active hepatitis (often characterized, e.g., by smooth muscle antibodies), primary biliary cirrhosis (often characterized, e.g., by mitchondrial antibodies), other endocrine gland failure (often characterized, e.g., by specific tissue antibodies in some cases), vitiligo (often characterized, e.g., by melanocyte antibodies), vasculitis (often characterized, e.g., by Ig and complement in vessel walls and/or low serum complement), post-MI (often characterized, e.g., by myocardial antibodies), cardiotomy syndrome (often characterized, e.g., by myocardial antibodies), urticaria (often characterized, e.g., by IgG and IgM antibodies to IgE), atopic dermatitis (often characterized, e.g., by IgG and IgM antibodies to IgE), asthma (often characterized, e.g., by IgG and IgM antibodies to IgE), inflammatory myopathies, and many other inflammatory, granulomatous, degenerative, and atrophic disorders.

In a preferred embodiment, therapeutic and pharmaceutical compositions of the invention, are used to treat, prevent, ameliorate, diagnose or prognose, a member of the group: autoimmune hemolytic anemia, as primary glomerulonephritis, IgA glomerulonephritis, Goodpasture's syndrome, idiopathic thrombocytopenia, Multiple Sclerosis, Myasthenia Gravis, Pemphigus, polymyositis/dermatomyositis, relapsing polychondritis, rheumatoid arthritis, Sjögren's syndrome, systemic lupus erythematosus, Uveitis, vasculitis, and primary biliary cirrhosis.

In another preferred embodiment, therapeutic and pharmaceutical compositions of the invention, are used to treat, prevent, ameliorate, diagnose or prognose, an immune based-rheumatologic disease, such as, for example, SLE, rheumatoid arthritis, CREST syndrome (a variant of scleroderma characterized by calcinosis, Raynaud's phenomenon, esophageal motility disorders, sclerodactyly, and telangiectasia.), Seronegative spondyloarthropathy (SpA), polymyositis/dermatomyositis, microscopic polyangiitis, hepatitis C-associated arthritis, Takayasu's arteritis, and undifferentiated connective tissue disorder.

In a specific preferred embodiment, therapeutic and pharmaceutical compositions of the invention, are used to treat, prevent, ameliorate, diagnose or prognose, rheumatoid arthritis and/or medical conditions associated therewith.

For example, an antibody, or antibodies, of the present invention are used to treat patients with clinical diagnosis of rheumatoid arthritis (RA). The patient treated preferably will not have a B cell malignancy. Moreover, the patient is optionally further treated with any one or more agents employed for treating RA such as salicylate; nonsteroidal anti-inflammatory drugs such as indomethacin, phenylbutazone, phenylacetic acid derivatives (e.g. ibuprofen and fenoprofen), naphthalene acetic acids (naproxen), pyrrolealkanoic acid (tometin), indoleacetic acids (sulindac), halogenated anthranilic acid (meclofenamate sodium), piroxicam, zomepirac and diflunisal; antimalarials such as chloroquine; gold salts; penicillamine; or immunosuppressive agents such as methotrexate or corticosteroids in dosages known for such drugs or reduced dosages. Preferably however, the patient is only treated with an antibody, or antibodies, of the present invention. Antibodies of the present invention are administered to the RA patient according to a dosing schedule as described infra, which may be readily determined by one of ordinary skill in the art. The primary response is determined by the Paulus index (Paulus et al. Athritis Rheum. 33:477–484 (1990)), i.e. improvement in morning stiffness, number of painful and inflamed joints, erythrocyte sedimentation (ESR), and at least a 2-point improvement on a 5-point scale of disease severity assessed by patient and by physician. Administration of an antibody, or antibodies, of the present invention will alleviate one or more of the symptoms of RA in the patient treated as described above.

In a specific preferred embodiment, therapeutic and pharmaceutical compositions of the invention, are used to treat, prevent, amelioate, diagnose or prognose, lupus and/or medical conditions associated therewith. Lupus-associated conditions that may be treated, prevented, ameliorated, prognosed and/or diagnosed with the antibodies and antibody compositions of the invention include, but are not limited to, hematologic disorders (e.g., hemolytic anemia, leukopenia, lymphopenia, and thrombocytopenia), immunologic disorders (e.g., anti-DNA antibodies, and anti-Sm antibodies), rashes, photosensitivity, oral ulcers, arthritis, fever, fatigue, weight loss, serositis (e.g., pleuritus (pleurisy)), renal disorders (e.g., nephritis), neurological disorders (e.g., seizures, peripheral neuropathy, CNS related disorders), gastroinstestinal disorders, Raynaud phenomenon, and pericarditis. In a preferred embodiment, therapeutic and pharmaceutical compositions of the invention are used to treat, prevent, ameliorate, diagnose, or prognose, renal disorders associated with systemic lupus erythematosus. In a most preferred embodiment, therapeutic and pharmaceutical compositions of the invention are used to treat, prevent, ameliorate, diagnose, or prognose, nephritis associated with systemic lupus erythematosus. In another most preferred embodiment, therapeutic or pharmaceutical compositions of the invention are administered to an animal to treat, prevent or ameliorate lupus or glomerular nephritis.

In a further specific embodiment, antibodies of the invention are used to treat, inhibit, prognose, diagnose or prevent hemolytic anemia. For example, patients diagnosed with autoimmune hemolytic anemia (AIHA), e.g., cryoglobinemia or Coombs positive anemia, are treated with an antibody, or antibodies, of the present invention. AIHA is an acquired hemolytic anemia due to auto-antibodies that react with the patient's red blood cells. The patient treated preferably will not have a B cell malignancy. Further adjunct therapies (such as glucocorticoids, prednisone, azathioprine, cyclophosphamide, vinca-laden platelets or Danazol) may be combined with the antibody therapy, but preferably the patient is treated with an antibody, or antibodies, of the present invention as a single-agent throughout the course of therapy. Antibodies of the present invention are administered to the hemolytic anemia patient according to a dosing schedule as described infra, which may be readily determined by one of ordinary skill in the art. Overall response rate is determined based upon an improvement in blood counts, decreased requirement for transfusions, improved hemoglobin levels and/or a decrease in the evidence of hemolysis as determined by standard chemical parameters. Administration of an antibody, or antibodies of the present invention will improve any one or more of the symptoms of hemolytic anemia in the patient treated as described above. For example, the patient treated as described above will show an increase in hemoglobin and an improvement in chemical parameters of hemolysis or return to normal as measured by serum lactic dehydrogenase and/or bilirubin.

In another specific preferred embodiment, therapeutic and pharmaceutical compositions of the invention, are used to treat, prevent, ameliorate, diagnose or prognose, Sjögren's Syndrome and/or medical conditions associated therewith.

In another specific preferred embodiment, therapeutic and pharmaceutical compositions of the invention, are used to treat, prevent, ameliorate, diagnose or prognose, HIV infection and/or medical conditions associated therewith (e.g. AIDS).

In another specific preferred embodiment, therapeutic and pharmaceutical compositions of the invention, are used to treat, prevent, ameliorate, diagnose or prognose, Myasthenia gravis and/or medical conditions associated therewith.

In another specific preferred embodiment, therapeutic and pharmaceutical compositions of the invention, are used to treat, prevent, ameliorate, diagnose or prognose, IgA nephropathy and/or medical conditions associated therewith.

In another specific preferred embodiment, therapeutic and pharmaceutical compositions of the invention, are used to treat, prevent, ameliorate, diagnose or prognose, hemolytic anemia and/or medical conditions associated therewith.

In another specific preferred embodiment, therapeutic and pharmaceutical compositions of the invention, are used to treat, prevent, ameliorate, diagnose or prognose, thyroiditis and/or medical conditions associated therewith.

In another specific preferred embodiment, therapeutic and pharmaceutical compositions of the invention, are used to treat, prevent, ameliorate, diagnose or prognose, Goodpasture's Syndrome and/or medical conditions associated therewith.

In another specific preferred embodiment, therapeutic and pharmaceutical compositions of the invention, are used to treat, prevent, ameliorate, diagnose or prognose, multiple sclerosis and/or medical conditions associated therewith.

In another specific preferred embodiment, therapeutic and pharmaceutical compositions of the invention, are used to treat, prevent, ameliorate, diagnose or prognose, chronic lymphocytic leukemia (CLL) and/or medical conditions associated therewith.

In another specific preferred embodiment, therapeutic and pharmaceutical compositions of the invention, are used to treat, prevent, ameliorate, diagnose or prognose, multiple myeloma and/or medical conditions associated therewith.

In another specific preferred embodiment, therapeutic and pharmaceutical compositions of the invention, are used to treat, prevent, ameliorate, diagnose or prognose, Non-Hodgkin's lymphoma and/or medical conditions associated therewith.

In another specific preferred embodiment, therapeutic and pharmaceutical compositions of the invention, are used to treat, prevent, ameliorate, diagnose or prognose, Hodgkin's disease and/or medical conditions associated therewith.

In another specific embodiment, antibodies of the invention are used to treat, inhibit, prognose, diagnose or prevent adult immune thrombocytopenic purpura. Adult immune thrombocytopenic purpura (ITP) is a relatively rare hematologic disorder that constitutes the most common of the immune-mediated cytopenias. The disease typically presents with severe thrombocytopenia that may be associated with acute hemorrhage in the presence of normal to increased megakaryocytes in the bone marrow. Most patients with ITP have an IgG antibody directed against target antigens on the outer surface of the platelet membrane, resulting in platelet sequestration in the spleen and accelerated reticuloendothelial destruction of platelets (Bussell, J. B. Hematol. Oncol. Clin. North Am. (4):179 (1990)). A number of therapeutic interventions have been shown to be effective in the treatment of ITP. Steroids are generally considered first-line therapy, after which most patients are candidates for intravenous immunoglobulin (IVIG), splenectomy, or other medical therapies including vincristine or immunosuppressive/cytotoxic agents. Up to 80% of patients with ITP initially respond to a course of steroids, but far fewer have complete and lasting remissions. Splenectomy has been recommended as standard second-line therapy for steroid failures, and leads to prolonged remission in nearly 60% of cases yet may result in reduced immunity to infection. Splenectomy is a major surgical procedure that may be associated with substantial morbidity (15%) and mortality (2%). IVIG has also been used as second line medical therapy, although only a small proportion of adult patients with ITP achieve remission. Therapeutic options that would interfere with the production of autoantibodies by activated B cells without the associated morbidities that occur with corticosteroids and/or splenectomy would provide an important treatment approach for a proportion of patients with ITP. Patients with clinical diagnosis of ITP are treated with an antibody, or antibodies of the present invention, optionally in combination with steroid therapy. The patient treated will not have a B cell malignancy. Antibodies of the present invention are administered to the RA patient according to a dosing schedule as described infra, which may be readily determined by one of ordinary skill in the art. Overall patient response rate is determined based upon a platelet count determined on two consecutive occasions two weeks apart following treatments as described above. See, George et al. "Idiopathic Thrombocytopenic Purpura: A Practice Guideline Developed by Explicit Methods for The American Society of Hematology", Blood 88:3–40 (1996), expressly incorporated herein by reference.

In another embodiment, therapeutic or pharmaceutical compositions of the invention are administered to an animal to treat, prevent or ameliorate an IgE-mediated allergic reaction or histamine-mediated allergic reaction. Examples of allergic reactions include, but are not limited to, asthma, rhinitis, eczema, chronic urticaria, and atopic dermatitis. In another embodiment, therapeutic or pharmaceutical compositions of the invention are administered to an animal to treat, prevent, or ameliorate anaphylaxis, hypersensitivity to an antigenic molecule, or blood group incompatibility. In another embodiment, therapeutic or pharmaceutical compositions of the invention are administered to an animal to treat, prevent or ameliorate or modulate inflammation or an inflammatory disorder. Examples of chronic and acute inflammatory disorders that may be treated prevented or ameliorated with the therapeutic and pharmaceutical compositions of the invention include, but are not limited to, chronic prostatitis, granulomatous prostatitis and malacoplakia, inflammation associated with infection (e.g., septic shock, sepsis, or systemic inflammatory response syndrome (SIRS)), ischemia-reperfusion injury, endotoxin lethality, arthritis, complement-mediated hyperacute rejection, nephritis, cytokine or chemokine induced lung injury, Crohn's disease, inflammatory bowel disease, chronic and acute inflammatory pulmonary diseases, bacterial infection, psoriasis, septicemia, cerebral malaria, arthritis, gastroenteritis, and glomerular nephritis.

In another embodiment, therapeutic or pharmaceutical compositions of the invention are administered to an animal to treat, prevent or ameliorate ischemia and arteriosclerosis. Examples of such disorders include, but are not limited to, reperfusion damage (e.g., in the heart and/or brain) and cardiac hypertrophy.

Therapeutic or pharmaceutical compositions of the invention, may also be administered to modulate blood clotting and to treat or prevent blood clotting disorders, such as, for example, antibody-mediated thrombosis (i.e., antiphospholipid antibody syndrome (APS)). For example, therapeutic or pharmaceutical compositions of the invention, may inhibit the proliferation and differentiation of cells involved in producing anticardiolipin antibodies. These compositions of the invention can be used to treat, prevent, ameliorate, diagnose, and/or prognose thrombotic related events including, but not limited to, stroke (and recurrent stroke), heart attack, deep vein thrombosis, pulmonary embolism, myocardial infarction, coronary artery disease (e.g., antibody-mediated coronary artery disease), thrombosis, graft reocclusion following cardiovascular surgery (e.g., coronary arterial bypass grafts, recurrent fetal loss, and recurrent cardiovascular thromboembolic events.

Therapeutic or pharmaceutical compositions of the invention, may also be administered to treat, prevent, or ameliorate organ rejection or graft-versus-host disease (GVHD) and/or conditions associated therewith. Organ rejection occurs by host immune cell destruction of the transplanted tissue through an immune response. Similarly, an immune response is also involved in GVHD, but, in this case, the foreign transplanted immune cells destroy the host tissues. The administration of antibodies of the invention, that inhibit an immune response, may be an effective therapy in preventing organ rejection or GVHD.

In another embodiment, therapeutic or pharmaceutical compositions of the invention are administered to an animal to treat, prevent or ameliorate a disease or disorder diseases associated with increased apoptosis including, but not limited to, AIDS, neurodegenerative disorders (such as Alzheimer's disease, Parkinson's disease, Amyotrophic lateral sclerosis, Retinitis pigmentosa, Cerebellar degeneration), myelodysplastic syndromes (such as aplastic anemia), ischemic injury (such as that caused by myocardial infarction, stroke and reperfusion injury), toxin-induced liver disease (such as that caused by alcohol), septic shock, cachexia and anorexia. In another embodiment, therapeutic or pharmaceutical compositions of the invention are administered to an animal to treat, prevent or ameliorate bone marrow failure, for example, aplastic anemia and myelodysplastic syndrome.

In another embodiment, therapeutic or pharmaceutical compositions of the invention are administered to an animal to treat, prevent or ameliorate growth, progression, and/or metastases of malignancies and proliferative disorders associated with increased cell survival, or the inhibition of apoptosis. Examples of such disorders, include, but are not limited to, leukemia (e.g., acute leukemia such as acute lymphocytic leukemia and acute myelocytic leukemia), neoplasms, tumors (e.g., fibrosarcoma, myxosarcoma, liposarcoma, chondrosarcoma, osteogenic sarcoma, chordoma, angiosarcoma, endotheliosarcoma, lymphangiosarcoma, lymphangioendotheliosarcoma, synovioma, mesothelioma, Ewing's tumor, leiomyosarcoma, rhabdomyosarcoma, colon carcinoma, pancreatic cancer, breast cancer, ovarian cancer, prostate cancer, squamous cell carcinoma, basal cell carcinoma, adenocarcinoma, sweat gland carcinoma, sebaceous gland carcinoma, papillary carcinoma, papillary adenocarcinomas, cystadenocarcinoma, medullary carcinoma, bronchogenic carcinoma, renal cell carcinoma, hepatoma, bile duct carcinoma, choriocarcinoma, seminoma, embryonal carcinoma, Wilms' tumor, cervical cancer, testicular tumor, lung carcinoma, small cell lung carcinoma, bladder carcinoma, epithelial carcinoma, glioma, astrocytoma, medulloblastoma, craniopharyngioma, ependymoma, pinealoma, hemangioblastoma, acoustic neuroma, oligodendroglioma, meningioma, melanoma, neuroblastoma, and retinoblastoma), heavy chain disease, metastases, or any disease or disorder characterized by uncontrolled cell growth.

In a specific embodiment, therapeutic or pharmaceutical compositions of the invention are used to treat or prevent a disorder characterized by hpergammagloulinemia (e.g., AIDS, autoimmune diseases, and some immunodeficiencies).

In a specific embodiment, therapeutic or pharmaceutical compositions of the invention are used to treat or prevent a disorder characterized by deficient serum immunoglobulin production, recurrent infections, and/or immune system dysfunction. Moreover, therapeutic or pharmaceutical compositions of the invention may be used to treat or prevent infections of the joints, bones, skin, and/or parotid glands, blood-borne infections (e.g., sepsis, meningitis, septic arthritis, and/or osteomyelitis), autoimmune diseases (e.g., those disclosed herein), inflammatory disorders, and malignancies, and/or any disease or disorder or condition associated with these infections, diseases, disorders and/or malignancies) including, but not limited to, CVID, other primary immune deficiencies, HIV disease, CLL, recurrent bronchitis, sinusitis, otitis media, conjunctivitis, pneumonia, hepatitis, meningitis, herpes zoster (e.g., severe herpes zoster), and/or *pneumocystis carnii.*

Therapeutic or pharmaceutical compositions of the invention of the invention thereof, may be used to diagnose, prognose, treat or prevent one or more of the following diseases or disorders, or conditions associated therewith: primary immuodeficiencies, immune-mediated thrombocytopenia, Kawasaki syndrome, bone marrow transplant (e.g., recent bone marrow transplant in adults or children), chronic B-cell lymphocytic leukemia, HIV infection (e.g., adult or pediatric HIV infection), chronic inflammatory demyelinating polyneuropathy, and post-transfusion purpura.

Additionally, therapeutic or pharmaceutical compositions of the invention may be used to diagnose, prognose, treat or prevent one or more of the following diseases, disorders, or conditions associated therewith, Guillain-Barre syndrome, anemia (e.g., anemia associated with parvovirus B19, patients with stable multiple myeloma who are at high risk for infection (e.g., recurrent infection), autoimmune hemolytic anemia (e.g., warm-type autoimmune hemolytic anemia), thrombocytopenia (e.g., neonatal thrombocytopenia), and immune-mediated neutropenia), transplantation (e.g., cytomegalovirus (CMV)-negative recipients of CMV-positive organs), hypogammaglobulinemia (e.g., hypogammaglobulinemic neonates with risk factor for infection or morbidity), epilepsy (e.g., intractable epilepsy), systemic vasculitic syndromes, myasthenia gravis (e.g., decompensation in myasthenia gravis), dermatomyositis, and polymyositis.

Additional preferred embodiments of the invention include, but are not limited to, the use of therapeutic or pharmaceutical compositions of the invention in the following applications:

Administration to an animal (e.g., mouse, rat, rabbit, hamster, guinea pig, pigs, micro-pig, chicken, camel, goat, horse, cow, sheep, dog, cat, non-human primate, and human, most preferably human) to boost the immune system to produce increased quantities of one or more antibodies (e.g., IgG, IgA, IgM, and IgE), to induce higher affinity antibody production (e.g., IgG, IgA, IgM, and IgE), and/or to increase an immune response. In a specific nonexclusive embodiment, therapeutic or pharmaceutical compositions of the invention are administered to boost the immune system to produce increased quantities of IgG. In another specific nonexclusive embodiment, antibodies of the are administered to boost the immune system to produce increased quantities of IgA. In another specific nonexclusive embodiment antibodies of the invention are administered to boost the immune system to produce increased quantities of IgM.

Administration to an animal (including, but not limited to, those listed above, and also including transgenic animals) incapable of producing functional endogenous antibody molecules or having an otherwise compromised endogenous immune system, but which is capable of producing human immunoglobulin molecules by means of a reconstituted or partially reconstituted immune system from another animal (see, e.g., published PCT Application Nos. WO98/24893, WO/9634096, WO/9633735, and WO/9110741).

In a specific embodiment, therapeutic or pharmaceutical compositions of the invention are used as a vaccine adjuvant that enhances immune responsiveness to specific antigen. In a specific embodiment, the vaccine is an antibody described herein. In another specific embodiment, the vaccine adjuvant is a polynucleotide described herein (e.g., an antibody polynucleotide genetic vaccine adjuvant). As discussed herein, therapeutic or pharmaceutical compositions of the invention may be administered using techniques known in the art, including but not limited to, liposomal delivery, recombinant vector delivery, injection of naked DNA, and gene gun delivery.

In a specific embodiment, therapeutic or pharmaceutical compositions of the invention are used as an adjuvant to enhance tumor-specific immune responses.

In a specific embodiment, therapeutic or pharmaceutical compositions of the invention are used as an adjuvant to enhance anti-viral immune responses. Anti-viral immune responses that may be enhanced using the compositions of the invention as an adjuvant, include, but are not limited to, virus and virus associated diseases or symptoms described herein or otherwise known in the art. In specific embodiments, the compositions of the invention are used as an adjuvant to enhance an immune response to a virus, disease, or symptom selected from the group consisting of: AIDS, meningitis, Dengue, EBV, and hepatitis (e.g., hepatitis B). In another specific embodiment, the compositions of the invention are used as an adjuvant to enhance an immune response to a virus, disease, or symptom selected from the group consisting of: HIV/AIDS, Respiratory syncytial virus, Dengue, Rotavirus, Japanese B encephalitis, Influenza A and B, Parainfluenza, Measles, Cytomegalovirus, Rabies, Junin, Chikungunya, Rift Valley fever, Herpes simplex, and yellow fever. In another specific embodiment, the compositions of the invention are used as an adjuvant to enhance an immune response to the HIV gp120 antigen.

In a specific embodiment, therapeutic or pharmaceutical compositions of the invention are used as an adjuvant to enhance anti-bacterial or anti-fungal immune responses. Anti-bacterial or anti-fungal immune responses that may be enhanced using the compositions of the invention as an adjuvant, include bacteria or fungus and bacteria or fungus associated diseases or symptoms described herein or otherwise known in the art. In specific embodiments, the compositions of the invention are used as an adjuvant to enhance an immune response to a bacteria or fungus, disease, or symptom selected from the group consisting of: tetanus, Diphtheria, botulism, and meningitis type B. In another specific embodiment, the compositions of the invention are used as an adjuvant to enhance an immune response to a bacteria or fungus, disease, or symptom selected from the group consisting of: *Vibrio cholerae, Mycobacterium leprae, Salmonella typhi, Salmonella paratyphi, Neisseria meningitidis, Streptococcus pneumoniae*, Group B *streptococcus, Shigella* spp., Enterotoxigenic *Escherichia coli*, Enterohemorrhagic *E. coli, Borrelia burgdorferi*, and *Plasmodium* (malaria).

In a specific embodiment, therapeutic or pharmaceutical compositions of the invention are used as an adjuvant to enhance anti-parasitic immune responses. Anti-parasitic immune responses that may be enhanced using the compositions of the invention as an adjuvant, include parasite and parasite associated diseases or symptoms described herein or otherwise known in the art. In specific embodiments, the compositions of the invention are used as an adjuvant to enhance an immune response to a parasite. In another specific embodiment, the compositions of the invention are used as an adjuvant to enhance an immune response to *Plasmodium* (malaria).

In a specific embodiment, compositions of the invention may be administered to patients as vaccine adjuvants. In a further specific embodiment, compositions of the invention may be administered as vaccine adjuvants to patients suffering from an immune-deficiency. In a further specific embodiment, compositions of the invention may be administered as vaccine adjuvants to patients suffering from HIV.

In a specific embodiment, compositions of the invention may be used to increase or enhance antigen-specific antibody responses to standard and experimental vaccines. In a specific embodiment, compositions of the invention may be used to enhance seroconversion in patients treated with standard and experimental vaccines. In another specific embodiment, compositions of the invention may be used to increase the repertoire of antibodies recognizing unique epitopes in response to standard and experimental vaccination.

In a preferred embodiment, antibodies of the invention (including antibody fragments and variants, and anti-antibody antibodies) increase or enhance antigen-specific antibody responses to standard and experimental vaccines by regulating binding of the soluble form of B Lymphocyte Stimulator to a B Lymphocyte Stimulator receptor (e.g., BCMA and TACI). In another preferred embodiment, antibodies of the invention (including antibody fragments and variants, and anti-antibody antibodies) increase or enhance antigen-specific antibody responses to standard and experimental vaccines by regulating binding of the soluble form of APRIL to an APRIL receptor (e.g., BCMA and TACI).

In a preferred embodiment, antibodies of the invention (including antibody fragments and variants, and anti-antibody antibodies) increase or enhance seroconversion in patients treated with standard and experimental vaccines by regulating binding of the soluble form of B Lymphocyte Stimulator to B Lymphocyte Stimulator receptor (e.g., BCMA and TACI). In another preferred embodiment, antibodies of the invention (including antibody fragments and variants, and anti-antibody antibodies) increase or enhance seroconversion in patients treated with standard and experimental vaccines by regulating binding of the soluble form of APRIL to an APRIL receptor (e.g., BCMA and TACI).

In a preferred embodiment, antibodies of the invention (including antibody fragments and variants, and anti-antibody antibodies) increase or enhance the repertoire of antibodies recognizing unique epitopes in response to standard and experimental vaccination by regulating binding of the soluble form of B Lymphocyte Stimulator to a B Lymphocyte Stimulator receptor (e.g., BCMA and TACI). In another preferred embodiment, antibodies of the invention (including antibody fragments and variants, and anti-antibody antibodies) increase or enhance the repertoire of antibodies recognizing unique epitopes in response to standard and experimental vaccination by regulating binding of the soluble form of APRIL to an APRIL receptor (e.g., BCMA and TACI).

In a specific embodiment, therapeutic or pharmaceutical compositions of the invention are used as a stimulator of B cell responsiveness to pathogens.

In a specific embodiment, therapeutic or pharmaceutical compositions of the invention are used as an agent that elevates the immune status of an individual prior to their receipt of immunosuppressive therapies.

In a specific embodiment, therapeutic or pharmaceutical compositions of the invention are used as an agent to induce higher affinity antibodies.

In a specific embodiment, therapeutic or pharmaceutical compositions of the invention are used as an agent to increase serum immunoglobulin concentrations.

In a specific embodiment, therapeutic or pharmaceutical compositions of the invention are used as an agent to accelerate recovery of immunocompromised individuals.

In a specific embodiment, therapeutic or pharmaceutical compositions of the invention are used as an agent to boost immunoresponsiveness among aged populations.

In a specific embodiment, therapeutic or pharmaceutical compositions of the invention are used as an immune system enhancer prior to, during, or after bone marrow transplant and/or other transplants (e.g., allogeneic or xenogeneic organ transplantation). With respect to transplantation, compositions of the invention may be administered prior to, concomitant with, and/or after transplantation. In a specific embodiment, compositions of the invention are administered after transplantation, prior to the beginning of recovery of T-cell populations. In another specific embodiment, compositions of the invention are first administered after transplantation after the beginning of recovery of T cell populations, but prior to full recovery of B cell populations.

In a specific embodiment, therapeutic or pharmaceutical compositions of the invention are used as an agent to boost immunoresponsiveness among B cell immunodeficient individuals, such as, for example, an individual who has undergone a partial or complete splenectomy. B cell immunodeficiencies that may be ameliorated or treated by administering the antibodies and/or compositions of the invention include, but are not limited to, severe combined immunodeficiency (SCID)-X linked, SCID-autosomal, adenosine deaminase deficiency (ADA deficiency), X-linked agammaglobulinemia (XLA), Bruton's disease, congenital agammaglobulinemia, X-linked infantile agammaglobulinemia, acquired agammaglobulinemia, adult onset agammaglobulinemia, late-onset agammaglobulinemia, dysgammaglobulinemia, hypogammaglobulinemia, transient hypogammaglobulinemia of infancy, unspecified hypogammaglobulinemia, agammaglobulinemia, common variable immunodeficiency (CVID) (acquired), Wiskott-Aldrich Syndrome (WAS), X-linked immunodeficiency with hyper IgM, non X-linked immunodeficiency with hyper IgM, selective IgA deficiency, IgG subclass deficiency (with or without IgA deficiency), antibody deficiency with normal or elevated Igs, immunodeficiency with thymoma, Ig heavy chain deletions, kappa chain deficiency, B cell lymphoproliferative disorder (BLPD), selective IgM immunodeficiency, recessive agammaglobulinemia (Swiss type), reticular dysgenesis, neonatal neutropenia, severe congenital leukopenia, thymic alymphoplasia-aplasia or dysplasia with immunodeficiency, ataxia-telangiectasia, short limbed dwarfism, X-linked lymphoproliferative syndrome (XLP), Nezelof syndrome-combined immunodeficiency with Igs, purine nucleoside phosphorylase deficiency (PNP), MHC Class II deficiency (Bare Lymphocyte Syndrome) and severe combined immunodeficiency.

In a specific embodiment, antibodies and/or compositions of the invention are administered to treat or ameliorate selective IgA deficiency.

In another specific embodiment, antibodies and/or compositions of the invention are administered to treat or ameliorate ataxia-telangiectasia.

In another specific embodiment antibodies and/or compositions of the invention are administered to treat or ameliorate common variable immunodeficiency.

In another specific embodiment, antibodies and/or compositions of the invention are administered to treat or ameliorate X-linked agammaglobulinemia.

In another specific embodiment, antibodies and/or compositions of the invention are administered to treat or ameliorate severe combined immunodeficiency (SCID).

In another specific embodiment, antibodies and/or compositions of the invention are administered to treat or ameliorate Wiskott-Aldrich syndrome.

In another specific embodiment, antibodies and/or compositions of the invention are administered to treat or ameliorate X-linked Ig deficiency with hyper IgM.

As an agent to boost immunoresponsiveness among individuals having an acquired loss of B cell function. Conditions resulting in an acquired loss of B cell function that may be ameliorated or treated by administering antibodies and/or compositions of the invention include, but are not limited to, HIV Infection, AIDS, bone marrow transplant, and B cell chronic lymphocytic leukemia (CLL).

In a specific embodiment, therapeutic or pharmaceutical compositions of the invention are used as an agent to boost immunoresponsiveness among individuals having a temporary immune deficiency. Conditions resulting in a temporary immune deficiency that may be ameliorated or treated by administering antibodies and/or compositions of the invention include, but are not limited to, recovery from viral infections (e.g., influenza), conditions associated with malnutrition, recovery from infectious mononucleosis, or conditions associated with stress, recovery from measles, recovery from blood transfusion, recovery from surgery.

In a specific embodiment, therapeutic or pharmaceutical compositions of the invention are used as a regulator of antigen presentation by monocytes, dendritic cells, T cells and/or B-cells. In one embodiment, antibody polypeptides or polynucleotides enhance antigen presentation or antagonize antigen presentation in vitro or in vivo. Moreover, in related embodiments, this enhancement or antagonization of antigen presentation may be useful in anti-tumor treatment or to modulate the immune system.

In a specific embodiment, therapeutic or pharmaceutical compositions of the invention are used as a mediator of mucosal immune responses. The expression of B Lymphocyte Stimulator on monocytes, the expression of B Lymphocyte Stimulator receptor on B cells, and the responsiveness of B cells to B Lymphocyte Stimulator suggests that it may be involved in exchange of signals between B cells and monocytes or their differentiated progeny. This activity is in many ways analogous to the CD40-CD154 signalling between B cells and T cells. Anti-B Lymphocyte Stimulator antibodies and compositions of the invention may therefore be good regulators of T cell independent immune responses to environmental pathogens. In particular, the unconventional B cell populations (CD5+) that are associated with mucosal sites and responsible for much of the innate immunity in humans may respond to antibodies or compositions of the invention thereby enhancing or inhibiting individual's immune status.

In a specific embodiment, therapeutic or pharmaceutical compositions of the invention are used as an agent to direct an individual's immune system towards development of a humoral response (i.e. TH2) as opposed to a TH1 cellular response.

In a specific embodiment, therapeutic or pharmaceutical compositions of the invention are used as a means to induce tumor proliferation and thus make it more susceptible to anti-neoplastic agents. For example, multiple myeloma is a slowly dividing disease and is thus refractory to virtually all anti-neoplastic regimens. If these cells were forced to proliferate more rapidly, their susceptibility profile would likely change.

In a specific embodiment, therapeutic or pharmaceutical compositions of the invention are used as a monocyte cell specific binding protein to which specific activators or inhibitors of cell growth may be attached. The result would be to focus the activity of such activators or inhibitors onto normal, diseased, or neoplastic B cell populations.

In a specific embodiment, therapeutic or pharmaceutical compositions of the invention are used as a B cell specific binding protein to which specific activators or inhibitors of cell growth may be attached. The result would be to focus the activity of such activators or inhibitors onto normal, diseased, or neoplastic B cell populations.

In a specific embodiment, therapeutic or pharmaceutical compositions of the invention are used as a means of detecting monocytic cells by virtue of its specificity. This application may require labeling the protein with biotin or other agents (e.g., as described herein) to afford a means of detection.

In a specific embodiment, therapeutic or pharmaceutical compositions of the invention are used as a means of detecting B-lineage cells by virtue of its specificity. This application may require labeling the protein with biotin or other agents (e.g., as described herein) to afford a means of detection.

In a specific embodiment, therapeutic or pharmaceutical compositions of the invention are used as a stimulator of B cell production in pathologies such as AIDS, chronic lymphocyte disorder and/or Common Variable immunodeficiency.

In a specific embodiment, therapeutic or pharmaceutical compositions of the invention are used as part of a monocyte selection device the function of which is to isolate monocytes from a heterogeneous mixture of cell types. Antibodies of the invention could be coupled to a solid support to which monocytes would then specifically bind. Unbound cells would be washed out and the bound cells subsequently eluted. A non-limiting use of this selection would be to allow purging of tumor cells from, for example, bone marrow or peripheral blood prior to transplant.

In a specific embodiment, therapeutic or pharmaceutical compositions of the invention are used as part of a B cell selection device the function of which is to isolate B cells from a heterogeneous mixture of cell types. Antibodies of the invention (that do not inhibit B Lymphocyte Stimulator/B Lymphocyte Stimulator Receptor interaction) binding soluble B Lymphocyte Stimulator could be coupled to a solid support to which B cells would then specifically bind. Unbound cells would be washed out and the bound cells subsequently eluted. A non-limiting use of this selection would be to allow purging of tumor cells from, for example, bone marrow or peripheral blood prior to transplant.

In a specific embodiment, therapeutic or pharmaceutical compositions of the invention are used as a therapy for generation and/or regeneration of lymphoid tissues following surgery, trauma or genetic defect.

In a specific embodiment, therapeutic or pharmaceutical compositions of the invention are used as a gene-based therapy for genetically inherited disorders resulting in immuno-incompetence such as observed among SCID patients.

In a specific embodiment, therapeutic or pharmaceutical compositions of the invention are used as an antigen for the generation of antibodies to inhibit or enhance B Lymphocyte Stimulator mediated responses.

In a specific embodiment, therapeutic or pharmaceutical compositions of the invention are used as a means of activating monocytes/macrophages to defend against parasitic diseases that effect monocytes such as *Leishmania.*

In a specific embodiment, therapeutic or pharmaceutical compositions of the invention are used as pretreatment of bone marrow samples prior to transplant. Such treatment would increase B cell representation and thus accelerate recovery.

In a specific embodiment, therapeutic or pharmaceutical compositions of the invention are used as a means of regulating secreted cytokines that are elicited by B Lymphocyte Stimulator and/or B Lymphocyte Stimulator receptor.

Antibody polypeptides or polynucleotides of the invention may be used to modulate IgE concentrations in vitro or in vivo.

Additionally, antibody polypeptides or polynucleotides of the invention may be used to treat, prevent, and/or diagnose IgE-mediated allergic reactions. Such allergic reactions include, but are not limited to, asthma, rhinitis, and eczema.

In a specific embodiment, antibody polypeptides or polynucleotides of the invention, are administered to treat, prevent, diagnose, and/or ameliorate selective IgA deficiency.

In another specific embodiment antibody polypeptides or polynucleotides of the invention are administered to treat, prevent, diagnose, and/or ameliorate ataxia-telangiectasia.

In another specific embodiment, antibody polypeptides or polynucleotides of the invention are administered to treat, prevent, diagnose, and/or ameliorate common variable immunodeficiency.

In another specific embodiment, antibody polypeptides or polynucleotides of the invention are administered to treat, prevent, diagnose, and/or ameliorate X-linked agammaglobulinemia.

In another specific embodiment, antibody polypeptides or polynucleotides of the invention are administered to treat, prevent, diagnose, and/or ameliorate severe combined immunodeficiency (SCID).

In another specific embodiment, antibody polypeptides or polynucleotides of the invention are administered to treat, prevent, diagnose, and/or ameliorate Wiskott-Aldrich syndrome.

In another specific embodiment, antibody polypeptides or polynucleotides of the invention are administered to treat, prevent, diagnose, and/or ameliorate X-linked Ig deficiency with hyper IgM. In a specific embodiment antibody polypeptides or polynucleotides of the invention are administered to treat, prevent, diagnose, and/or ameliorate X-linked Ig deficiency with hyper IgM.

In another specific embodiment, antibody polypeptides or polynucleotides of the invention are administered to treat, prevent, and/or diagnose chronic myelogenous leukemia, acute myelogenous leukemia, leukemia, hystiocytic leukemia, monocytic leukemia (e.g., acute monocytic leukemia), leukemic reticulosis, Shilling Type monocytic leukemia, and/or other leukemias derived from monocytes and/or monocytic cells and/or tissues.

In another specific embodiment, antibody polypeptides or polynucleotides of the invention are administered to treat, prevent, diagnose, and/or ameliorate monocytic leukemoid reaction, as seen, for example, with tuberculosis.

In another specific embodiment, antibody polypeptides or polynucleotides of the invention are administered to treat, prevent, diagnose, and/or ameliorate monocytic leukocytosis, monocytic leukopenia, monocytopenia, and/or monocytosis.

In a specific embodiment, antibody polypeptides or polynucleotides of the invention are used to treat, prevent, detect, and/or diagnose monocyte disorders and/or diseases, and/or conditions associated therewith.

In a specific embodiment, antibody polypeptides or polynucleotides of the invention are used to treat, prevent, detect, and/or diagnose primary B lymphocyte disorders and/or diseases, and/or conditions associated therewith. In one embodiment, such primary B lymphocyte disorders, diseases, and/or conditions are characterized by a complete or partial loss of humoral immunity. Primary B lymphocyte disorders, diseases, and/or conditions associated therewith that are characterized by a complete or partial loss of humoral immunity and that may be prevented, treated, detected and/or diagnosed with compositions of the invention include, but are not limited to, X-Linked Agammaglobulinemia (XLA), severe combined immunodeficiency disease (SCID), and selective IgA deficiency.

In a preferred embodiment antibody polypeptides or polynucleotides of the invention are used to treat, prevent, and/or diagnose diseases or disorders affecting or conditions associated with any one or more of the various mucous membranes of the body. Such diseases or disorders include, but are not limited to, for example, mucositis, mucoclasis, mucocolitis, mucocutaneous leishmaniasis (such as, for example, American leishmaniasis, leishmaniasis americana, nasopharyngeal leishmaniasis, and New World leishmaniasis), mucocutaneous lymph node syndrome (for example, Kawasaki disease), mucoenteritis, mucoepidermoid carcinoma, mucoepidermoid tumor, mucoepithelial dysplasia, mucoid adenocarcinoma, mucoid degeneration, myxoid degeneration; myxomatous degeneration; myxomatosis, mucoid medial degeneration (for example, cystic medial necrosis), mucolipidosis (including, for example, mucolipidosis I, mucolipidosis II, mucolipidosis III, and mucolipidosis IV), mucolysis disorders, mucomembranous enteritis, mucoenteritis, mucopolysaccharidosis (such as, for example, type I mucopolysaccharidosis (i.e., Hurler's syndrome), type IS mucopolysaccharidosis (i.e., Scheie's syndrome or type V mucopolysaccharidosis), type II mucopolysaccharidosis (i.e., Hunter's syndrome), type III mucopolysaccharidosis (i.e., Sanfilippo's syndrome), type IV mucopolysaccharidosis (i.e., Morquio's syndrome), type VI mucopolysaccharidosis (i.e., Maroteaux-Lamy syndrome), type VII mucopolysaccharidosis (i.e, mucopolysaccharidosis due to beta-glucuronidase deficiency), and mucosulfatidosis), mucopolysacchariduria, mucopurulent conjunctivitis, mucopus, mucormycosis (i.e., zygomycosis), mucosal disease (i.e., bovine virus diarrhea), mucous colitis (such as, for example, mucocolitis and myxomembranous colitis), and mucoviscidosis (such as, for example, cystic fibrosis, cystic fibrosis of the pancreas, Clarke-Hadfield syndrome, fibrocystic disease of the pancreas, mucoviscidosis, and viscidosis). In a highly preferred embodiment, antibody polypeptides or polynucleotides of the invention are used to treat, prevent, and/or diagnose mucositis, especially as associated with chemotherapy.

In a preferred embodiment, antibody polypeptides or polynucleotides of the invention are used to treat, prevent, and/or diagnose diseases or disorders affecting or conditions associated with sinusitis.

An additional condition, disease or symptom that can be treated, prevented, and/or diagnosed by antibody polypeptides or polynucleotides of the invention is osteomyelitis.

An additional condition, disease or symptom that can be treated, prevented, and/or diagnosed by antibody polypeptides or polynucleotides of the invention is endocarditis.

All of the above described applications as they may apply to veterinary medicine.

Antibody polypeptides or polynucleotides of the invention may be used to treat, prevent, and/or diagnose diseases and disorders of the pulmonary system (e.g., bronchi such as, for example, sinopulmonary and bronchial infections and conditions associated with such diseases and disorders and other respiratory diseases and disorders. In specific embodiments, such diseases and disorders include, but are not limited to, bronchial adenoma, bronchial asthma, pneumonia (such as, e.g., bronchial pneumonia, bronchopneumonia, and tuberculous bronchopneumonia), chronic obstructive pulmonary disease (COPD), bronchial polyps, bronchiectasia (such as, e.g., bronchiectasia sicca, cylindrical bronchiectasis, and saccular bronchiectasis), bronchiolar adenocarcinoma, bronchiolar carcinoma, bronchiolitis (such as, e.g., exudative bronchiolitis, bronchiolitis fibrosa obliterans, and proliferative bronchiolitis), bronchiolo-alveolar carcinoma, bronchitic asthma, bronchitis (such as, e.g., asthmatic bronchitis, Castellani's bronchitis, chronic bronchitis, croupous bronchitis, fibrinous bronchitis, hemorrhagic bronchitis, infectious avian bronchitis, obliterative bronchitis, plastic bronchitis, pseudomembranous bronchitis, putrid bronchitis, and verminous bronchitis), bronchocentric granulomatosis, bronchoedema, bronchoesophageal fistula, bronchogenic carcinoma, bronchogenic cyst, broncholithiasis, bronchomalacia, bronchomycosis (such as, e.g., bronchopulmonary aspergillosis), bronchopulmonary spirochetosis, hemorrhagic bronchitis, bronchorrhea, bronchospasm, bronchostaxis, bronchostenosis, Biot's respiration, bronchial respiration, Kussmaul respiration, Kussmaul-Kien respiration, respiratory acidosis, respiratory alkalosis, respiratory distress syndrome of the newborn, respiratory insufficiency, respiratory scleroma, respiratory syncytial virus, and the like.

In a specific embodiment, antibody polypeptides or polynucleotides of the invention are used to treat, prevent, and/or diagnose chronic obstructive pulmonary disease (COPD).

In another embodiment, antibody polypeptides or polynucleotides of the invention are used to treat, prevent, and/or diagnose fibroses and conditions associated with fibroses, including, but not limited to, cystic fibrosis (including such fibroses as cystic fibrosis of the pancreas, Clarke-Hadfield syndrome, fibrocystic disease of the pancreas, mucoviscidosis, and viscidosis), endomyocardial fibrosis, idiopathic retroperitoneal fibrosis, leptomeningeal fibrosis, mediastinal fibrosis, nodular subepidermal fibrosis, pericentral fibrosis, perimuscular fibrosis, pipestem fibrosis, replacement fibrosis, subadventitial fibrosis, and Symmers' clay pipestem fibrosis.

In another embodiment, therapeutic or pharmaceutical compositions of the invention are administered to an animal to treat, prevent or ameliorate infectious diseases. Infectious diseases include diseases associated with yeast, fungal, viral and bacterial infections. Viruses causing viral infections which can be treated or prevented in accordance with this invention include, but are not limited to, retroviruses (e.g., human T-cell lymphotrophic virus (HTLV) types I and II and human immunodeficiency virus (HIV)), herpes viruses (e.g., herpes simplex virus (HSV) types I and II, Epstein-Barr virus, HHV6-HHV8, and cytomegalovirus), arenavirues (e.g., lassa fever virus), paramyxoviruses (e.g., morbillivirus virus, human respiratory syncytial virus, mumps, and pneumovirus), adenoviruses, bunyaviruses (e.g., hantavirus), cornaviruses, filoviruses (e.g., Ebola virus), flaviviruses (e.g., hepatitis C virus (HCV), yellow fever virus, and Japanese encephalitis virus), hepadnaviruses (e.g., hepatitis B viruses (HBV)), orthomyoviruses (e.g., influenza viruses A, B and C), papovaviruses (e.g., papillomavirues), picornaviruses (e.g., rhinoviruses, enteroviruses and hepatitis A viruses), poxviruses, reoviruses (e.g., rotavirues), togaviruses (e.g., rubella virus), rhabdoviruses (e.g., rabies virus). Microbial pathogens causing bacterial infections include, but are not limited to, *Streptococcus pyogenes, Streptococcus pneumoniae, Neisseria gonorrhoea, Neisseria meningitidis, Corynebacterium diphtheriae, Clostridium botulinum, Clostridium perfringens, Clostridium tetani, Haemophilus influenzae, Klebsiella pneumoniae, Klebsiella ozaenae, Klebsiella rhinoscleromotis, Staphylococcus aureus, Vibrio cholerae, Escherichia coli, Pseudomonas aeruginosa, Campylobacter* (*Vibrio*) fetus, *Campylobacter jejuni, Aeromonas hydrophila, Bacillus cereus, Edwardsiella tarda, Yersinia enterocolitica, Yersinia pestis, Yersinia pseudotuberculosis, Shigella dysenteriae, Shigella flexneri, Shigella sonnei, Salmonella typhimurium, Treponema pallidum, Treponema pertenue, Treponema carateneum, Borrelia vincentii, Borrelia burgdorferi, Leptospira icterohemorrhagiae, Mycobacterium tuberculosis, Toxoplasma gondii, Pneumocystis carinii, Francisella tularensis, Brucella abortus, Brucella suis, Brucella melitensis, Mycoplasma* spp., *Rickettsia prowazeki, Rickettsia tsutsugumushi, Chlamydia* spp., and *Helicobacter pylori.*

Gene Therapy

In a specific embodiment, nucleic acids comprising sequences encoding antibodies or functional derivatives thereof, are administered to treat, inhibit or prevent a disease or disorder associated with aberrant expression and/or activity of B Lymphocyte Stimulator and/or its receptor, by way of gene therapy. Gene therapy refers to therapy performed by the administration to a subject of an expressed or expressible nucleic acid. In this embodiment of the invention, the nucleic acids produce their encoded protein that mediates a therapeutic effect.

Any of the methods for gene therapy available in the art can be used according to the present invention. Exemplary methods are described below.

For general reviews of the methods of gene therapy, see Goldspiel et al., Clinical Pharmacy 12:488–505 (1993); Wu and Wu, Biotherapy 3:87–95 (1991); Tolstoshev, Ann. Rev. Pharmacol. Toxicol. 32:573–596 (1993); Mulligan, Science 260:926–932 (1993); and Morgan and Anderson, Ann. Rev. Biochem. 62:191–217 (1993); May, TIBTECH 1 1(5): 155–215 (1993). Methods commonly known in the art of recombinant DNA technology which can be used are described in Ausubel et al. (eds.), Current Protocols in Molecular Biology, John Wiley & Sons, NY (1993); and Kriegler, Gene Transfer and Expression, A Laboratory Manual, Stockton Press, NY (1990).

In a preferred aspect, a composition of the invention comprises, or alternatively consists of, nucleic acids encoding an antibody, said nucleic acids being part of an expression vector that expresses the antibody or fragments or chimeric proteins or heavy or light chains thereof in a suitable host. In particular, such nucleic acids have promoters, preferably heterologous promoters, operably linked to the antibody coding region, said promoter being inducible or constitutive, and, optionally, tissue-specific. In another particular embodiment, nucleic acid molecules are used in which the antibody coding sequences and any other desired sequences are flanked by regions that promote homologous recombination at a desired site in the genome, thus providing for intrachromosomal expression of the antibody encoding nucleic acids (Koller and Smithies, Proc. Natl. Acad. Sci. USA 86:8932–8935 (1989); Zijlstra et al., Nature 342: 435–438 (1989). In specific embodiments, the expressed antibody molecule is an scFv; alternatively, the nucleic acid sequences include sequences encoding both the heavy and light chains, or fragments or variants thereof, of an antibody.

Delivery of the nucleic acids into a patient may be either direct, in which case the patient is directly exposed to the nucleic acid or nucleic acid-carrying vectors, or indirect, in which case, cells are first transformed with the nucleic acids in vitro, then transplanted into the patient. These two approaches are known, respectively, as in vivo or ex vivo gene therapy.

In a specific embodiment, the nucleic acid sequences are directly administered in vivo, where it is expressed to produce the encoded product. This can be accomplished by any of numerous methods known in the art, e.g., by constructing them as part of an appropriate nucleic acid expression vector and administering it so that they become intracellular, e.g., by infection using defective or attenuated retrovirals or other viral vectors (see U.S. Pat. No. 4,980, 286), or by direct injection of naked DNA, or by use of microparticle bombardment (e.g., a gene gun; Biolistic, Dupont), or coating with lipids or cell-surface receptors or transfecting agents, encapsulation in liposomes, microparticles, or microcapsules, or by administering them in linkage to a peptide which is known to enter the nucleus, by administering it in linkage to a ligand subject to receptor-mediated endocytosis (see, e.g., Wu and Wu, J. Biol. Chem. 262:4429–4432 (1987)) (which can be used to target cell types specifically expressing the receptors), etc. In another embodiment, nucleic acid-ligand complexes can be formed in which the ligand comprises a fusogenic viral peptide to disrupt endosomes, allowing the nucleic acid to avoid lysosomal degradation. In yet another embodiment, the nucleic acid can be targeted in vivo for cell specific uptake and expression, by targeting a specific receptor (see, e.g., PCT Publications WO 92/06180; WO 92/22635; WO92/20316; WO93/14188, WO 93/20221). Alternatively, the nucleic acid can be introduced intracellularly and incorporated within host cell DNA for expression, by homologous recombination (Koller and Smithies, Proc. Natl. Acad. Sci. USA 86:8932–8935 (1989); Zijlstra et al., Nature 342:435–438 (1989)).

In a specific embodiment, viral vectors that contains nucleic acid sequences encoding an antibody of the invention or fragments or variants thereof are used. For example, a retroviral vector can be used (see Miller et al., Meth. Enzymol. 217:581–599 (1993)). These retroviral vectors contain the components necessary for the correct packaging of the viral genome and integration into the host cell DNA. The nucleic acid sequences encoding the antibody to be used in gene therapy are cloned into one or more vectors, which facilitates delivery of the gene into a patient. More detail about retroviral vectors can be found in Boesen et al., Biotherapy 6:291–302 (1994), which describes the use of a retroviral vector to deliver the mdr 1 gene to hematopoietic stem cells in order to make the stem cells more resistant to chemotherapy. Other references illustrating the use of retroviral vectors in gene therapy are: Clowes et al., J. Clin. Invest. 93:644–651(1994); Klein et al., Blood 83:1467–1473 (1994); Salmons and Gunzberg, Human Gene Therapy 4:129–141 (1993); and Grossman and Wilson, Curr. Opin. in Genetics and Devel. 3:110–114 (1993).

Adenoviruses are other viral vectors that can be used in gene therapy. Adenoviruses are especially attractive vehicles for delivering genes to respiratory epithelia. Adenoviruses naturally infect respiratory epithelia where they cause a mild disease. Other targets for adenovirus-based delivery systems are liver, the central nervous system, endothelial cells, and muscle. Adenoviruses have the advantage of being capable of infecting non-dividing cells. Kozarsky and Wilson, Current Opinion in Genetics and Development 3:499–503 (1993) present a review of adenovirus-based gene therapy. Bout et al., Human Gene Therapy 5:3–10 (1994) demonstrated the use of adenovirus vectors to transfer genes to the respiratory epithelia of rhesus monkeys. Other instances of the use of adenoviruses in gene therapy can be found in Rosenfeld et al., Science 252:431–434 (1991); Rosenfeld et al., Cell 68:143–155 (1992); Mastrangeli et al., J. Clin. Invest. 91:225–234 (1993); PCT Publication WO94/12649; and Wang, et al., Gene Therapy 2:775–783 (1995). In a preferred embodiment, adenovirus vectors are used.

Adeno-associated virus (AAV) has also been proposed for use in gene therapy (Walsh et al., Proc. Soc. Exp. Biol. Med. 204:289–300 (1993); U.S. Pat. No. 5,436,146).

Another approach to gene therapy involves transferring a gene to cells in tissue culture by such methods as electroporation, lipofection, calcium phosphate mediated transfection, or viral infection. Usually, the method of transfer includes the transfer of a selectable marker to the cells. The cells are then placed under selection to isolate those cells that have taken up and are expressing the transferred gene. Those cells are then delivered to a patient.

In this embodiment, the nucleic acid is introduced into a cell prior to administration in vivo of the resulting recombinant cell. Such introduction can be carried out by any method known in the art, including but not limited to transfection, electroporation, microinjection, infection with a viral or bacteriophage vector containing the nucleic acid sequences, cell fusion, chromosome-mediated gene transfer, microcell-mediated gene transfer, spheroplast fusion, etc. Numerous techniques are known in the art for the introduction of foreign genes into cells (see, e.g., Loeffler and Behr, Meth. Enzymol. 217:599–618 (1993); Cohen et al., Meth. Enzymol. 217:618–644 (1993); Clin. Pharma. Ther. 29:69–92m (1985)) and may be used in accordance with the present invention, provided that the necessary developmental and physiological functions of the recipient cells are not disrupted. The technique should provide for the stable transfer of the nucleic acid to the cell, so that the nucleic acid is expressible by the cell and preferably heritable and expressible by its cell progeny.

The resulting recombinant cells can be delivered to a patient by various methods known in the art. Recombinant blood cells (e.g., hematopoietic stem or progenitor cells) are preferably administered intravenously. The amount of cells envisioned for use depends on the desired effect, patient state, etc., and can be determined by one skilled in the art.

Cells into which a nucleic acid can be introduced for purposes of gene therapy encompass any desired, available cell type, and include but are not limited to epithelial cells, endothelial cells, keratinocytes, fibroblasts, muscle cells, hepatocytes; blood cells such as T lymphocytes, B lymphocytes, monocytes, macrophages, neutrophils, eosinophils, megakaryocytes, granulocytes; various stem or progenitor cells, in particular hematopoietic stem or progenitor cells, e.g., as obtained from bone marrow, umbilical cord blood, peripheral blood, fetal liver, etc.

In a preferred embodiment, the cell used for gene therapy is autologous to the patient.

In an embodiment in which recombinant cells are used in gene therapy, nucleic acid sequences encoding an antibody or fragment thereof are introduced into the cells such that they are expressible by the cells or their progeny, and the recombinant cells are then administered in vivo for therapeutic effect. In a specific embodiment, stem or progenitor cells are used. Any stem and/or progenitor cells which can be isolated and maintained in vitro can potentially be used in accordance with this embodiment of the present invention (see e.g. PCT Publication WO 94/08598; Stemple and Anderson, Cell 7 1:973–985 (1992); Rheinwald, Meth. Cell Bio. 21A:229 (1980); and Pittelkow and Scott, Mayo Clinic Proc. 61:771 (1986)).

In a specific embodiment, the nucleic acid to be introduced for purposes of gene therapy comprises an inducible promoter operably linked to the coding region, such that expression of the nucleic acid is controllable by controlling the presence or absence of the appropriate inducer of transcription.

Demonstration of Therapeutic or Prophylactic Utility of a Composition

The compounds of the invention are preferably tested in vitro, and then in vivo for the desired therapeutic or prophylactic activity, prior to use in humans. For example, in vitro assays which can be used to determine whether administration of a specific antibody or composition of the present invention is indicated, include in vitro cell culture assays in which a patient tissue sample is grown in culture, and exposed to or otherwise administered an antibody or composition of the present invention, and the effect of such an antibody or composition of the present invention upon the tissue sample is observed. In various specific embodiments, in vitro assays can be carried out with representative cells of cell types involved in a patient's disorder, to determine if an antibody or composition of the present invention has a desired effect upon such cell types. Preferably, the antibodies or compositions of the invention are also tested in in vitro assays and animal model systems prior to administration to humans.

Antibodies or compositions of the present invention for use in therapy can be tested for their toxicity in suitable animal model systems, including but not limited to rats, mice, chicken, cows, monkeys, and rabbits. For in vivo testing of an antibody or composition's toxicity any animal model system known in the art may be used.

Efficacy in treating or preventing viral infection may be demonstrated by detecting the ability of an antibody or composition of the invention to inhibit the replication of the virus, to inhibit transmission or prevent the virus from establishing itself in its host, or to prevent, ameliorate or alleviate the symptoms of disease a progression. The treatment is considered therapeutic if there is, for example, a reduction in viral load, amelioration of one or more symptoms, or a decrease in mortality and/or morbidity following administration of an antibody or composition of the invention.

Antibodies or compositions of the invention can be tested for the ability to induce the expression of cytokines such as IFN-γ, by contacting cells, preferably human cells, with an antibody or composition of the invention or a control antibody or control composition and determining the ability of the antibody or composition of the invention to induce one or more cytokines. Techniques known to those of skill in the art can be used to measure the level of expression of cytokines. For example, the level of expression of cytokines can be measured by analyzing the level of RNA of cytokines by, for example, RT-PCR and Northern blot analysis, and by analyzing the level of cytokines by, for example, immunoprecipitation followed by western blot analysis and ELISA. In a preferred embodiment, a compound of the invention is tested for its ability to induce the expression of IFN-γ.

Antibodies or compositions of the invention can be tested for their ability to modulate the biological activity of immune cells by contacting immune cells, preferably human immune cells (e.g., T-cells, B-cells, and Natural Killer cells), with an antibody or composition of the invention or a control compound and determining the ability of the antibody or composition of the invention to modulate (i.e, increase or decrease) the biological activity of immune cells. The ability of an antibody or composition of the invention to modulate the biological activity of immune cells can be assessed by detecting the expression of antigens, detecting the proliferation of immune cells (i.e., B-cell proliferation), detecting the activation of signaling molecules, detecting the effector function of immune cells, or detecting the differentiation of immune cells. Techniques known to those of skill in the art can be used for measuring these activities. For example, cellular proliferation can be assayed by $^3$H-thymidine incorporation assays and trypan blue cell counts. Antigen expression can be assayed, for example, by immunoassays including, but not limited to, competitive and non-competitive assay systems using techniques such as western blots, immunohistochemistry radioimmunoassays, ELISA (enzyme linked immunosorbent assay), "sandwich" immunoassays, immunoprecipitation assays, precipitin reactions, gel diffusion precipitin reactions, immunodiffusion assays, agglutination assays, complement-fixation assays, immunoradiometric assays, fluorescent immunoassays, protein A immunoassays and FACS analysis. The activation of signaling molecules can be assayed, for example, by kinase assays and electrophoretic shift assays (EMSAs). In a preferred embodiment, the ability of an antibody or composition of the invention to induce B-cell proliferation is measured. In another preferred embodiment, the ability of an antibody or composition of the invention to modulate immunoglobulin expression is measured.

Antibodies or compositions of the invention can be tested for their ability to reduce tumor formation in in vitro, ex vivo and in vivo assays. Antibodies or compositions of the invention can also be tested for their ability to inhibit viral replication or reduce viral load in in vitro and in vivo assays. Antibodies or compositions of the invention can also be tested for their ability to reduce bacterial numbers in in vitro and in vivo assays known to those of skill in the art. Antibodies or compositions of the invention can also be tested for their ability to alleviate of one or more symptoms associated with cancer, an immune disorder (e.g., an inflammatory disease), a neurological disorder or an infectious disease. Antibodies or compositions of the invention can also be tested for their ability to decrease the time course of the infectious disease. Further, antibodies or compositions of the invention can be tested for their ability to increase the survival period of animals suffering from disease or disorder, including cancer, an immune disorder or an infectious disease. Techniques known to those of skill in the art can be used to analyze the function of the antibodies or compositions of the invention in vivo.

Therapeutic/Prophylactic Compositions and Administration

The invention provides methods of treatment, inhibition and prophylaxis by administration to a subject of an effective amount of antibody (or fragment or variant thereof) or pharmaceutical composition of the invention, preferably an antibody of the invention. In a preferred aspect, an antibody or fragment or variant thereof is substantially purified (i.e., substantially free from substances that limit its effect or produce undesired side-effects). The subject is preferably an animal, including but not limited to, animals such as cows, pigs, horses, chickens, cats, dogs, etc., and is preferably a mammal, and most preferably a human.

Formulations and methods of administration that can be employed when the compound comprises a nucleic acid or an immunoglobulin are described above; additional appropriate formulations and routes of administration can be selected from among those described herein below.

Various delivery systems are known and can be used to administer antibody or fragment or variant thereof of the invention, e.g., encapsulation in liposomes, microparticles, microcapsules, recombinant cells capable of expressing the antibody or antibody fragment, receptor-mediated endocytosis (see, e.g., Wu and Wu, J. Biol. Chem. 262:4429–4432 (1987)), construction of a nucleic acid as part of a retroviral or other vector, etc. Methods of introduction include, but are not limited to, intradermal, intramuscular, intraperitoneal, intravenous, subcutaneous, intranasal, epidural, and oral routes. The compositions may be administered by any convenient route, for example by infusion or bolus injection, by absorption through epithelial or mucocutaneous linings (e.g., oral mucosa, rectal and intestinal mucosa, etc.) and may be administered together with other biologically active agents. Administration can be systemic or local. In addition, it may be desirable to introduce the pharmaceutical compositions of the invention into the central nervous system by any suitable route, including intraventricular and intrathecal injection; intraventricular injection may be facilitated by an intraventricular catheter, for example, attached to a reservoir, such as an Ommaya reservoir. Pulmonary administration can also be employed, e.g., by use of an inhaler or nebulizer, and formulation with an aerosolizing agent.

In a specific embodiment, it may be desirable to administer the pharmaceutical compositions of the invention locally to the area in need of treatment; this may be achieved by, for example, and not by way of limitation, local infusion during surgery, topical application, e.g., in conjunction with a wound dressing after surgery, by injection, by means of a catheter, by means of a suppository, or by means of an implant, said implant being of a porous, non-porous, or gelatinous material, including membranes, such as sialastic membranes, or fibers. Preferably, when administering a protein, including an antibody, of the invention, care must be taken to use materials to which the protein does not absorb.

In another embodiment, the composition can be delivered in a vesicle, in particular a liposome (see Langer, Science 249:1527–1533 (1990); Treat et al., in Liposomes in the Therapy of Infectious Disease and Cancer, Lopez-Berestein and Fidler (eds.), Liss, New York, pp. 353–365 (1989); Lopez-Berestein, ibid., pp. 3 17–327; see generally ibid.).

In yet another embodiment, the composition can be delivered in a controlled release system. In one embodiment, a pump may be used (see Langer, supra; Sefton, CRC Crit. Ref. Biomed. Eng. 14:20 1 (1987); Buchwald et al., Surgery 88:507 (1980); Saudek et al., N. Engl. J. Med. 321:574 (1989)). In another embodiment, polymeric materials can be used (see Medical Applications of Controlled Release, Langer and Wise (eds.), CRC Pres., Boca Raton, Fla. (1974); Controlled Drug Bioavailability, Drug Product Design and Performance, Smolen and Ball (eds.), Wiley, New York (1984); Ranger and Peppas, J., Macromol. Sci. Rev. Macromol. Chem. 23:61 (1983); see also Levy et al., Science 228:190 (1985); During et al., Ann. Neurol. 25:35 1 (1989); Howard et al., J. Neurosurg. 7 1:105 (1989)). In yet another embodiment, a controlled release system can be placed in proximity of the therapeutic target, i.e., the brain, thus requiring only a fraction of the systemic dose (see, e.g., Goodson, in Medical Applications of Controlled Release, supra, vol. 2, pp. 115–138 (1984)).

Other controlled release systems are discussed in the review by Langer (Science 249:1527–1533 (1990)).

In a specific embodiment where the composition of the invention is a nucleic acid encoding a protein, the nucleic acid can be administered in vivo to promote expression of its encoded protein, by constructing it as part of an appropriate nucleic acid expression vector and administering it so that it becomes intracellular, e.g., by use of a retroviral vector (see U.S. Pat. No. 4,980,286), or by direct injection, or by use of microparticle bombardment (e.g., a gene gun; Biolistic, Dupont), or coating with lipids or cell-surface receptors or transfecting agents, or by administering it in linkage to a homeobox-like peptide which is known to enter the nucleus (see e.g., Joliot et al., Proc. Natl. Acad. Sci. USA 88:1864–1868 (1991)), etc. Alternatively, a nucleic acid can be introduced intracellularly and incorporated within host cell DNA for expression, by homologous recombination.

The present invention also provides pharmaceutical compositions. Such compositions comprise a therapeutically effective amount of an antibody or a fragment thereof, and a pharmaceutically acceptable carrier. In a specific embodiment, the term "pharmaceutically acceptable" means approved by a regulatory agency of the Federal or a state government or listed in the U.S. Pharmacopeia or other generally recognized pharmacopeia for use in animals, and more particularly in humans. The term "carrier" refers to a diluent, adjuvant, excipient, or vehicle with which the therapeutic is administered. Such pharmaceutical carriers can be sterile liquids, such as water and oils, including those of petroleum, animal, vegetable or synthetic origin, such as peanut oil, soybean oil, mineral oil, sesame oil and the like. Water is a preferred carrier when the pharmaceutical composition is administered intravenously. Saline solutions and aqueous dextrose and glycerol solutions can also be employed as liquid carriers, particularly for injectable solutions. Suitable pharmaceutical excipients include starch, glucose, lactose, sucrose, gelatin, malt, rice, flour, chalk, silica gel, sodium stearate, glycerol monostearate, talc, sodium chloride, dried skim milk, glycerol, propylene, glycol, water, ethanol and the like. The composition, if desired, can also contain minor amounts of wetting or emulsifying agents, or pH buffering agents. These compositions can take the form of solutions, suspensions, emulsion, tablets, pills, capsules, powders, sustained-release formulations and the like. The composition can be formulated as a suppository, with traditional binders and carriers such as triglycerides. Oral formulation can include standard carriers such as pharmaceutical grades of mannitol, lactose, starch, magnesium stearate, sodium saccharine, cellulose, magnesium carbonate, etc. Examples of suitable pharmaceutical carriers are described in "Remington's Pharmaceutical Sciences" by E. W. Martin. Such compositions will contain a therapeutically effective amount of the antibody or fragment thereof, preferably in purified form, together with a suitable amount of carrier so as to provide the form for proper administration to the patient. The formulation should suit the mode of administration.

In a preferred embodiment, the composition is formulated in accordance with routine procedures as a pharmaceutical composition adapted for intravenous administration to human beings. Typically, compositions for intravenous administration are solutions in sterile isotonic aqueous buffer. Where necessary, the composition may also include a solubilizing agent and a local anesthetic such as lignocamne to ease pain at the site of the injection. Generally, the ingredients are supplied either separately or mixed together in unit dosage form, for example, as a dry lyophilized powder or water free concentrate in a hermetically sealed container such as an ampoule or sachette indicating the quantity of active agent. Where the composition is to be administered by infusion, it can be dispensed with an infusion bottle containing sterile pharmaceutical grade water or saline. Where the composition is administered by injection, an ampoule of sterile water for injection or saline can be provided so that the ingredients may be mixed prior to administration.

The compositions of the invention can be formulated as neutral or salt forms. Pharmaceutically acceptable salts include those formed with anions such as those derived from hydrochloric, phosphoric, acetic, oxalic, tartaric acids, etc., and those formed with cations such as those derived from sodium, potassium, ammonium, calcium, ferric hydroxides, isopropylamine, triethylamine, 2-ethylamino ethanol, histidine, procaine, etc.

The amount of the composition of the invention which will be effective in the treatment, inhibition and prevention of a disease or disorder associated with aberrant expression and/or activity of a polypeptide of the invention can be determined by standard clinical techniques. In addition, in vitro assays may optionally be employed to help identify optimal dosage ranges. The precise dose to be employed in the formulation will also depend on the route of administration, and the seriousness of the disease or disorder, and should be decided according to the judgment of the practitioner and each patient's circumstances. Effective doses may be extrapolated from dose-response curves derived from in vitro or animal model test systems.

For antibodies, the dosage administered to a patient is typically 0.1 mg/kg to 100 mg/kg of the patient's body weight. Preferably, the dosage administered to a patient is between 0.1 mg/kg and 20 mg/kg of the patient's body weight, more preferably 1 mg/kg to 10 mg/kg of the patient's body weight. Generally, human antibodies have a longer half-life within the human body than antibodies from other species due to the immune response to the foreign polypeptides. Thus, lower dosages of human antibodies and less frequent administration is often possible. Further, the dosage and frequency of administration of therapeutic or pharmaceutical compositions of the invention may be reduced by enhancing uptake and tissue penetration (e.g., into the brain) of the antibodies by modifications such as, for example, lipidation.

The antibodies and antibody compositions of the invention may be administered alone or in combination with other adjuvants. Adjuvants that may be administered with the antibody and antibody compositions of the invention include, but are not limited to, alum, alum plus deoxycholate (ImmunoAg), MTP-PE (Biocine Corp.), QS21 (Genentech, Inc.), BCG, and MPL. In a specific embodiment, antibody and antibody compositions of the invention are administered in combination with alum. In another specific embodiment, antibody and antibody compositions of the invention are administered in combination with QS-21. Further adjuvants that may be administered with the antibody and antibody compositions of the invention include, but are not limited to, Monophosphoryl lipid immunomodulator, Adju Vax 100a, QS-21, QS-18, CRL1005, Aluminum salts, MF-59, and Virosomal adjuvant technology. Vaccines that may be administered with the antibody and antibody compositions of the invention include, but are not limited to, vaccines directed toward protection against MMR (measles, mumps, rubella), polio, varicella, tetanus/diptheria, hepatitis A, hepatitis B, *haemophilus influenzae* B, whooping cough, pneumonia, influenza, Lyme's Disease, rotavirus, cholera, yellow fever, Japanese encephalitis, poliomyelitis, rabies, typhoid fever, and pertussis, and/or PNEUMOVAX-23™. Combinations may be administered either concomitantly, e.g., as an admixture, separately but simultaneously or concurrently; or sequentially. This includes presentations in which the combined agents are administered together as a therapeutic mixture, and also procedures in which the combined agents are administered separately but simultaneously, e.g., as through separate intravenous lines into the same individual. Administration "in combination" further includes the separate administration of one of the compounds or agents given first, followed by the second.

In another specific embodiment, antibody and antibody compositions of the invention are used in combination with PNEUMOVAX-23™ to treat, prevent, and/or diagnose infection and/or any disease, disorder, and/or condition associated therewith. In one embodiment, antibody and antibody compositions of the invention are used in combination with PNEUMOVAX-23™ to treat, prevent, and/or diagnose any Gram positive bacterial infection and/or any disease, disorder, and/or condition associated therewith. In another embodiment, antibody and antibody compositions of the invention are used in combination with PNEUMOVAX-23™ to treat, prevent, and/or diagnose infection and/or any disease, disorder, and/or condition associated with one or more members of the genus *Enterococcus* and/or the genus *Streptococcus*. In another embodiment, antibody and antibody compositions of the invention are used in any combination with PNEUMOVAX-23™ to treat, prevent, and/or diagnose infection and/or any disease, disorder, and/or condition associated with one or more members of the Group B streptococci. In another embodiment, antibody and antibody compositions of the invention are used in combination with PNEUMOVAX-23™ to treat, prevent, and/or diagnose infection and/or any disease, disorder, and/or condition associated with *Streptococcus pneumoniae*.

The antibody and antibody compositions of the invention may be administered alone or in combination with other therapeutic agents, including but not limited to, chemotherapeutic agents, antibiotics, antivirals, steroidal and non-steroidal anti-inflammatories, conventional immunotherapeutic agents and cytokines. Combinations may be administered either concomitantly, e.g., as an admixture, separately but simultaneously or concurrently; or sequentially. This includes presentations in which the combined agents are administered together as a therapeutic mixture, and also procedures in which the combined agents are administered separately but simultaneously, e.g., as through separate intravenous lines into the same individual. Administration "in combination" further includes the separate administration of one of the compounds or agents given first, followed by the second.

In one embodiment, the antibody and antibody compositions of the invention are administered in combination with other members of the TNF family. TNF, TNF-related or TNF-like molecules that may be administered with the antibody and antibody compositions of the invention include, but are not limited to, soluble forms of TNF-alpha, lymphotoxin-alpha (LT-alpha, also known as TNF-beta), LT-beta (found in complex heterotrimer LT-alpha2-beta), OPGL, FasL, CD27L, CD30L, CD40L, 4-1BBL, DcR3, OX40L, TNF-gamma (International Publication No. WO 96/14328), TRAIL, AIM-II (International Publication No. WO 97/34911), APRIL (J. Exp. Med. 188(6):1185–1190 (1998)), endokine-alpha (International Publication No. WO 98/07880), Neutrokine-alpha (Internatioanl Application Publication No. WO 98/18921), OPG, OX40, and nerve growth factor (NGF), and soluble forms of Fas, CD30, CD27, CD40 and 4-IBB, TR2 (International Publication No. WO 96/34095), DR3 (International Publication No. WO 97/33904), DR4 (International Publication No. WO 98/32856), TR5 (International Publication No. WO 98/30693), TR6 (International Publication No. WO 98/30694), TR7 (International Publication No. WO 98/41629), TRANK, TR9 (International Publication No. WO 98/56892), 312C2 (International Publication No. WO 98/06842), and TR12, and soluble forms CD154, CD70, and CD153.

In a preferred embodiment, the antibody and antibody compositions of the invention are administered in combination with CD40 ligand (CD40L), a soluble form of CD40L (e.g., AVREND™), biologically active fragments, variants, or derivatives of CD40L, anti-CD40L antibodies (e.g., agonistic or antagonistic antibodies), and/or anti-CD40 antibodies (e.g., agonistic or antagonistic antibodies).

In an additional embodiment, the antibody and antibody compositions of the invention are administered alone or in combination with an anti-angiogenic agent(s). Anti-angiogenic agents that may be administered with the antibody and antibody compositions of the invention include, but are not limited to, Angiostatin (Entremed, Rockville, Md.), Troponin-1 (Boston Life Sciences, Boston, Mass.), anti-Invasive Factor, retinoic acid and derivatives thereof, paclitaxel (Taxol), Suramin, Tissue Inhibitor of Metalloproteinase-1, Tissue Inhibitor of Metalloproteinase-2, VEGI, Plasminogen Activator Inhibitor-1, Plasminogen Activator Inhibitor-2, and various forms of the lighter "d group" transition metals.

Lighter "d group" transition metals include, for example, vanadium, molybdenum, tungsten, titanium, niobium, and tantalum species. Such transition metal species may form transition metal complexes. Suitable complexes of the above-mentioned transition metal species include oxo transition metal complexes.

Representative examples of vanadium complexes include oxo vanadium complexes such as vanadate and vanadyl complexes. Suitable vanadate complexes include metavanadate and orthovanadate complexes such as, for example, ammonium metavanadate, sodium metavanadate, and sodium orthovanadate. Suitable vanadyl complexes include, for example, vanadyl acetylacetonate and vanadyl sulfate including vanadyl sulfate hydrates such as vanadyl sulfate mono- and trihydrates.

Representative examples of tungsten and molybdenum complexes also include oxo complexes. Suitable oxo tungsten complexes include tungstate and tungsten oxide complexes. Suitable tungstate complexes include ammonium tungstate, calcium tungstate, sodium tungstate dihydrate, and tungstic acid. Suitable tungsten oxides include tungsten (IV) oxide and tungsten (VI) oxide. Suitable oxo molybdenum complexes include molybdate, molybdenum oxide, and molybdenyl complexes. Suitable molybdate complexes include ammonium molybdate and its hydrates, sodium molybdate and its hydrates, and potassium molybdate and its hydrates. Suitable molybdenum oxides include molybdenum (VI) oxide, molybdenum (VI) oxide, and molybdic acid. Suitable molybdenyl complexes include, for example, molybdenyl acetylacetonate. Other suitable tungsten and molybdenum complexes include hydroxo derivatives derived from, for example, glycerol, tartaric acid, and sugars.

A wide variety of other anti-angiogenic factors may also be utilized within the context of the present invention. Representative examples include, but are not limited to, platelet factor 4; protamine sulphate; sulphated chitin derivatives (prepared from queen crab shells), (Murata et al., Cancer Res. 51:22–26, 1991); Sulphated Polysaccharide Peptidoglycan Complex (SP-PG) (the function of this compound may be enhanced by the presence of steroids such as estrogen, and tamoxifen citrate); Staurosporine; modulators of matrix metabolism, including for example, proline analogs, cishydroxyproline, d,L-3,4-dehydroproline, Thiaproline, alpha,alpha-dipyridyl, aminopropionitrile fumarate; 4-propyl-5-(4-pyridinyl)-2 (3H)-oxazolone; Methotrexate; Mitoxantrone; Heparin; Interferons; 2 Macroglobulin-serum; ChIMP-3 (Pavloff et al., J. Bio. Chem. 267:17321–17326, 1992); Chymostatin (Tomikinson et al., Biochem J. 286:475–480, 1992); Cyclodextrin Tetradecasulfate; Eponemycin; Camptothecin; Fumagillin (Ingber et al., Nature 348:555–557, 1990); Gold Sodium Thiomalate ("GST"; Matsubara and Ziff, J. Clin. Invest. 79:1440–1446, 1987); anticollagenase-serum; alpha2-antiplasmin (Holmes et al., J. Biol. Chem. 262(4):1659–1664, 1987); Bisantrene (National Cancer Institute); Lobenzarit disodium (N-(2)-carboxyphenyl-4-chloroanthronilic acid disodium or "CCA"; (Takeuchi et al., Agents Actions 36:312–316, 1992); and metalloproteinase inhibitors such as BB94.

Additional anti-angiogenic factors that may also be utilized within the context of the present invention include Thalidomide, (Celgene, Warren, N.J.); Angiostatic steroid; AGM-1470 (H. Brem and J. Folkman *J Pediatr. Surg.* 28:445–51 (1993)); an integrin alpha v beta 3 antagonist (C. Storgard et al., *J Clin. Invest.* 103:47–54 (1999)); carboxynaminolmidazole; Carboxyamidotriazole (CAI) (National Cancer Institute, Bethesda, Md.); Conbretastatin A-4 (CA4P) (OXiGENE, Boston, Mass.); Squalamine (Magainin Pharmaceuticals, Plymouth Meeting, Pa.); TNP-470, (Tap Pharmaceuticals, Deerfield, Ill.); ZD-0101 AstraZeneca (London, UK); APRA (CT2584); Benefin, Byrostatin-1 (SC339555); CGP-41251 (PKC 412); CM101; Dexrazoxane (ICRF187); DMXAA; Endostatin; Flavopridiol; Genestein; GTE; ImmTher; Iressa (ZD1839); Octreotide (Somatostatin); Panretin; Penacillamine; Photopoint; PI-88; Prinomastat (AG-3340) Purlytin; Suradista (FCE26644); Tamoxifen (Nolvadex); Tazarotene; Tetrathiomolybdate; Xeloda (Capecitabine); and 5-Fluorouracil.

Anti-angiogenic agents that may be administered in combination with the compounds of the invention may work through a variety of mechanisms including, but not limited to, inhibiting proteolysis of the extracellular matrix, blocking the function of endothelial cell-extracellular matrix adhesion molecules, by antagonizing the function of angiogenesis inducers such as growth factors, and inhibiting integrin receptors expressed on proliferating endothelial cells. Examples of anti-angiogenic inhibitors that interfere with extracellular matrix proteolysis and which may be administered in combination with the antibody and antibody compositions of the invention include, but are not limited to, AG-3340 (Agouron, La Jolla, Calif.), BAY-12-9566 (Bayer, West Haven, Conn.), BMS-275291 (Bristol Myers Squibb, Princeton, N.J.), CGS-27032A (Novartis, East Hanover, N.J.), Marimastat (British Biotech, Oxford, UK), and Metastat (Aeterna, St-Foy, Quebec). Examples of anti-angiogenic inhibitors that act by blocking the function of endothelial cell-extracellular matrix adhesion molecules and which may be administered in combination with the antibody and antibody compositions of the invention include, but are not limited to, EMD-121974 (Merck KcgaA Darmstadt, Germany) and Vitaxin (Ixsys, La Jolla, Calif./Medimmune, Gaithersburg, Md.). Examples of anti-angiogenic agents that act by directly antagonizing or inhibiting angiogenesis inducers and which may be administered in combination with the antibody and antibody compositions of the invention include, but are not limited to, Angiozyme (Ribozyme, Boulder, Colo.), Anti-VEGF antibody (Genentech, S. San Francisco, Calif.), PTK-787/ZK-225846 (Novartis, Basel, Switzerland), SU-101 (Sugen, S. San Francisco, Calif.), SU-5416 (Sugen/Pharmacia Upjohn, Bridgewater, N.J.), and SU-6668 (Sugen). Other anti-angiogenic agents act to indirectly inhibit angiogenesis. Examples of indirect inhibitors of angiogenesis which may be administered in combination with the antibody and antibody compositions of the invention include, but are not limited to, IM-862 (Cytran, Kirkland, Wash.), Interferon-alpha, IL-12 (Roche, Nutley, N.J.), and Pentosan polysulfate (Georgetown University, Washington, D.C.).

In particular embodiments, the use of antibody and antibody compositions of the invention in combination with anti-angiogenic agents is contemplated for the treatment, prevention, and/or amelioration of an autoimmune disease, such as for example, an autoimmune disease described herein.

In a particular embodiment, the use of antibody and antibody compositions of the invention in combination with anti-angiogenic agents is contemplated for the treatment, prevention, and/or amelioration of arthritis. In a more particular embodiment, the use of antibody and antibody compositions of the invention in combination with anti-angiogenic agents is contemplated for the treatment, prevention, and/or amelioration of rheumatoid arthritis.

In another embodiment, antibody and antibody compositions of the invention are administered in combination with an anticoagulant. Anticoagulants that may be administered with the antibody and antibody compositions of the invention include, but are not limited to, heparin, warfarin, and aspirin. In a specific embodiment, antibody and antibody compositions of the invention are administered in combination with heparin and/or warfarin. In another specific embodiment, antibody and antibody compositions of the invention are administered in combination with warfarin. In another specific embodiment, antibody and antibody compositions of the invention are administered in combination with warfarin and aspirin. In another specific embodiment, antibody and antibody compositions of the invention are administered in combination with heparin. In another specific embodiment, antibody and antibody compositions of the invention are administered in combination with heparin and aspirin.

In another embodiment, antibody and antibody compositions of the invention are administered in combination with an agent that suppresses the production of anticardiolipin antibodies. In specific embodiments, the polynucleotides of the invention are administered in combination with an agent that blocks and/or reduces the ability of anticardiolipin antibodies to bind phospholipid-binding plasma protein beta 2-glycoprotein I (b2GPI).

In certain embodiments, antibody and antibody compositions of the invention are administered in combination with antiretroviral agents, nucleoside reverse transcriptase inhibitors, non-nucleoside reverse transcriptase inhibitors, and/or protease inhibitors. Nucleoside reverse transcriptase inhibitors that may be administered in combination with the antibody and antibody compositions of the invention, include, but are not limited to, RETROVIR™ (zidovudine/AZT), VIDEX™ (didanosine/ddI), HIVID™ (zalcitabine/ddC), ZERIT™ (stavudine/d4T), EPIVIR™ (lamivudine/3TC), and COMBIVIR™ (zidovudine/lamivudine). Non-nucleoside reverse transcriptase inhibitors that may be administered in combination with the antibody and antibody compositions of the invention, include, but are not limited to, VIRAMUNE™ (nevirapine), RESCRIPTOR™ (delavirdine), and SUSTIVA™ (efavirenz). Protease inhibitors that may be administered in combination with the antibody and antibody compositions of the invention, include, but are not limited to, CRIXIVAN™ (indinavir), NORVIR™ (ritonavir), INVIRASE™ (saquinavir), and VIRACEPT™ (nelfinavir). In a specific embodiment, antiretroviral agents, nucleoside reverse transcriptase inhibitors, non-nucleoside reverse transcriptase inhibitors, and/or protease inhibitors may be used in any combination with antibody and antibody compositions of the invention to treat, prevent, and/or diagnose AIDS and/or to treat, prevent, and/or diagnose HIV infection.

In other embodiments, antibody and antibody compositions of the invention may be administered in combination with anti-opportunistic infection agents. Anti-opportunistic agents that may be administered in combination with the antibody and antibody compositions of the invention, include, but are not limited to, TRIMETHOPRIM-SULFAMETHOXAZOLE™, DAPSONE™, PENTAMIDINE™, ATOVAQUONE™, ISONIAZID™, RIFAMPIN™, PYRAZINAMIDE™, ETHAMBUTOL™, RIFABUTIN™, CLARITHROMYCIN™, AZITHROMYCIN™, GANCICLOVIR™, FOSCARNET™, CIDOFOVIR™, FLUCONAZOLE™, ITRACONAZOLE™, KETOCONAZOLE™, ACYCLOVIR™, FAMCICOLVIR™, PYRIMETHAMINE™, LEUCOVORIN™, NEUPOGEN™ (filgrastim/G-CSF), and LEUKINE™ (sargramostim/GM-CSF). In a specific embodiment, antibody and antibody compositions of the invention are used in any combination with TRIMETHOPRIM-SULFAMETHOXAZOLE™, DAPSONE™, PENTAMIDINE™, and/or ATOVAQUONE™ to prophylactically treat, prevent, and/or diagnose an opportunistic *Pneumocystis carinii* pneumonia infection. In another specific embodiment, antibody and antibody compositions of the invention are used in any combination with ISONIAZID™, RIFAMPIN™, PYRAZINAMIDE™, and/or ETHAMBUTOL™ to prophylactically treat, prevent, and/or diagnose an opportunistic *Mycobacterium avium* complex infection. In another specific embodiment, antibody and antibody compositions of the invention are used in any combination with RIFABUTIN™, CLARITHROMYCIN™, and/or AZITHROMYCIN™ to prophylactically treat, prevent, and/or diagnose an opportunistic *Mycobacterium tuberculosis* infection. In another specific embodiment, antibody and antibody compositions of the invention are used in any combination with GANCICLOVIR™, FOSCARNET™, and/or CIDOFOVIR™ to prophylactically treat, prevent, and/or diagnose an opportunistic cytomegalovirus infection. In another specific embodiment, antibody and antibody compositions of the invention are used in any combination with FLUCONAZOLE™, ITRACONAZOLE™, and/or KETOCONAZOLE™ to prophylactically treat, prevent, and/or diagnose an opportunistic fungal infection. In another specific embodiment, antibody and antibody compositions of the invention are used in any combination with ACYCLOVIR™ and/or FAMCICOLVIR™ to prophylactically treat, prevent, and/or diagnose an opportunistic herpes simplex virus type I and/or type II infection. In another specific embodiment, antibody and antibody compositions of the invention are used in any combination with PYRIMETHAMINE™ and/or LEUCOVORIN™ to prophylactically treat, prevent, and/or diagnose an opportunistic *Toxoplasma gondii* infection. In another specific embodiment, antibody and antibody compositions of the invention are used in any combination with LEUCOVORIN™ and/or NEUPOGEN™ to prophylactically treat, prevent, and/or diagnose an opportunistic bacterial infection.

In a further embodiment, the antibody and antibody compositions of the invention are administered in combination with an antiviral agent. Antiviral agents that may be administered with the antibody and antibody compositions of the invention include, but are not limited to, acyclovir, ribavirin, amantadine, and remantidine.

In a further embodiment, the antibody and antibody compositions of the invention are administered in combination with an antibiotic agent. Antibiotic agents that may be administered with the antibody and antibody compositions of the invention include, but are not limited to, amoxicillin, aminoglycosides, beta-lactam (glycopeptide), beta-lactamases, Clindamycin, chloramphenicol, cephalosporins, ciprofloxacin, ciprofloxacin, erythromycin, fluoroquinolones, macrolides, metronidazole, penicillins, quinolones, rifampin, streptomycin, sulfonamide, tetracyclines, trimethoprim, trimethoprim-sulfamthoxazole, and vancomycin.

Conventional nonspecific immunosuppressive agents, that may be administered in combination with the antibody and antibody compositions of the invention include, but are not limited to, steroids, cyclosporine, cyclosporine analogs cyclophosphamide, cyclophosphamide IV, methylprednisolone, prednisolone, azathioprine, FK-506, 15-deoxyspergualin, and other immunosuppressive agents that act by suppressing the function of responding T cells.

In specific embodiments, antibody and antibody compositions of the invention are administered in combination with immunosuppressants. Immunosuppressants preparations that may be administered with the antibody and antibody compositions of the invention include, but are not limited to, ORTHOCLONE™ (OKT3), SANDIMMUNE™/NEORAL™/SANGDYA™ (cyclosporin), PROGRAF™ (tacrolimus), CELLCEPT™ (mycophenolate), Azathioprine, glucorticosteroids, and RAPAMUNE™ (sirolimus). In a specific embodiment, immunosuppressants may be used to prevent rejection of organ or bone marrow transplantation.

In a preferred embodiment, the antibody and antibody compositions of the invention are administered in combination with steroid therapy. Steroids that may be administered in combination with the antibody and antibody compositions of the invention, include, but are not limited to, oral corticosteroids, prednisone, and methylprednisolone (e.g., IV methylprednisolone). In a specific embodiment, antibody and antibody compositions of the invention are administered in combination with prednisone. In a further specific embodiment, the antibody and antibody compositions of the invention are administered in combination with prednisone and an immunosuppressive agent. Immunosuppressive agents that may be administered with the antibody and antibody compositions of the invention and prednisone are those described herein, and include, but are not limited to, azathioprine, cylophosphamide, and cyclophosphamide IV. In a another specific embodiment, antibody and antibody compositions of the invention are administered in combination with methylprednisolone. In a further specific embodiment, the antibody and antibody compositions of the invention are administered in combination with methylprednisolone and an immunosuppressive agent. Immunosuppressive agents that may be administered with the antibody and antibody compositions of the invention and methylprednisolone are those described herein, and include, but are not limited to, azathioprine, cylophosphamide, and cyclophosphamide IV.

In a preferred embodiment, the antibody and antibody compositions of the invention are administered in combination with an antimalarial. Antimalarials that may be administered with the antibody and antibody compositions of the invention include, but are not limited to, hydroxychloroquine, chloroquine, and/or quinacrine.

In a preferred embodiment, the antibody and antibody compositions of the invention are administered in combination with an NSAID.

In a nonexclusive embodiment, the antibody and antibody compositions of the invention are administered in combination with one, two, three, four, five, ten, or more of the following drugs: NRD-101 (Hoechst Marion Roussel), diclofenac (Dimethaid), oxaprozin potassium (Monsanto), mecasermin (Chiron), T-614 (Toyama), pemetrexed disodium (Eli Lilly), atreleuton (Abbott), valdecoxib (Monsanto), eltenac (Byk Gulden), campath, AGM-1470 (Takeda), CDP-571 (Celltech Chiroscience), CM-101 (CarboMed), ML-3000 (Merckle), CB-2431 (KS Biomedix), CBF-BS2 (KS Biomedix), IL-1Ra gene therapy (Valentis), JTE-522 (Japan Tobacco), paclitaxel (Angiotech), DW-166HC (Dong Wha), darbufelone mesylate (Warner-Lambert), soluble TNF receptor 1 (synergen; Amgen), IPR-6001 (Institute for Pharmaceutical Research), trocade (Hoffman-La Roche), EF-5 (Scotia Pharmaceuticals), BIIL-284 (Boehringer Ingelheim), BIIF-1149 (Boehringer Ingelheim), Leuko Vax (Inflammatics), MK-663 (Merck), ST-1482 (Sigma-Tau), and butixocort propionate (WarnerLambert).

In a preferred embodiment, the antibody and antibody compositions of the invention are administered in combination with one, two, three, four, five or more of the following drugs: methotrexate, sulfasalazine, sodium aurothiomalate, auranofin, cyclosporine, penicillamine, azathioprine, an antimalarial drug (e.g., as described herein), cyclophosphamide, chlorambucil, gold, ENBREL™ (Etanercept), anti-TNF antibody, LJP 394 (La Jolla Pharmaceutical Company, San Diego, Calif.) and prednisolone.

In a more preferred embodiment, the antibody and antibody compositions of the invention are administered in combination with an antimalarial, methotrexate, anti-TNF antibody, ENBREL™ and/or suflasalazine. In one embodiment, the antibody and antibody compositions of the invention are administered in combination with methotrexate. In another embodiment, the antibody and antibody compositions of the invention are administered in combination with anti-TNF antibody. In another embodiment, the antibody and antibody compositions of the invention are administered in combination with methotrexate and anti-TNF antibody. In another embodiment, the antibody and antibody compositions of the invention are administered in combination with suflasalazine. In another specific embodiment, the antibody and antibody compositions of the invention are administered in combination with methotrexate, anti-TNF antibody, and suflasalazine. In another embodiment, the antibody and antibody compositions of the invention are administered in combination ENBREL™. In another embodiment, the antibody and antibody compositions of the invention are administered in combination with ENBREL™ and methotrexate. In another embodiment, the antibody and antibody compositions of the invention are administered in combination with ENBREL™, methotrexate and suflasalazine. In another embodiment, the antibody and antibody compositions of the invention are administered in combination with ENBREL™, methotrexate and suflasalazine. In other embodiments, one or more antimalarials is combined with one of the above-recited combinations. In a specfic embodiment, the antibody and antibody compositions of the invention are administered in combination with an antimalarial (e.g., hydroxychloroquine), ENBREL™, methotrexate and suflasalazine. In another specfic embodiment, the antibody and antibody compositions of the invention are administered in combination with an antimalarial (e.g., hydroxychloroquine), sulfasalazine, anti-TNF antibody, and methotrexate.

In an additional embodiment, antibody and antibody compositions of the invention are administered alone or in combination with one or more intravenous immune globulin preparations. Intravenous immune globulin preparations that may be administered with the antibody and antibody compositions of the invention include, but not limited to, GAMMAR™, IVEEGAM™, SANDOGLOBULIN™, GAMMAGARD S/D™, and GAMIMUNE™. In a specific embodiment, antibody and antibody compositions of the invention are administered in combination with intravenous immune globulin preparations in transplantation therapy (e.g., bone marrow transplant).

CD40 ligand (CD40L), a soluble form of CD40L (e.g., AVREND™), biologically active fragments, variants, or derivatives of CD40L, anti-CD40L antibodies (e.g., agonistic or antagonistic antibodies), and/or anti-CD40 antibodies (e.g., agonistic or antagonistic antibodies).

In an additional embodiment, the antibody and antibody compositions of the invention are administered alone or in combination with an anti-inflammatory agent. Anti-inflammatory agents that may be administered with the antibody and antibody compositions of the invention include, but are not limited to, glucocorticoids and the nonsteroidal anti-inflammatories, aminoarylcarboxylic acid derivatives, arylacetic acid derivatives, arylbutyric acid derivatives, arylcarboxylic acids, arylpropionic acid derivatives, pyrazoles, pyrazolones, salicylic acid derivatives, thiazinecarboxamides, e-acetamidocaproic acid, S-adenosylmethionine, 3-amino-4-hydroxybutyric acid, amixetrine, bendazac, benzydamine, bucolome, difenpiramide, ditazol, emorfazone, guaiazulene, nabumetone, nimesulide, orgotein, oxaceprol, paranyline, perisoxal, pifoxime, proquazone, proxazole, and tenidap.

In another embodiment, compostions of the invention are administered in combination with a chemotherapeutic agent. Chemotherapeutic agents that may be administered with the antibody and antibody compositions of the invention include, but are not limited to, antibiotic derivatives (e.g., doxorubicin, bleomycin, daunorubicin, and dactinomycin); antiestrogens (e.g., tamoxifen); antimetabolites (e.g., fluorouracil, 5-FU, methotrexate, floxuridine, interferon alpha-2b, glutamic acid, plicamycin, mercaptopurine, and 6-thioguanine); cytotoxic agents (e.g., carmustine, BCNU, lomustine, CCNU, cytosine arabinoside, cyclophosphamide, estramustine, hydroxyurea, procarbazine, mitomycin, busulfan, cis-platin, and vincristine sulfate); hormones (e.g., medroxyprogesterone, estramustine phosphate sodium, ethinyl estradiol, estradiol, megestrol acetate, methyltestosterone, diethylstilbestrol diphosphate, chlorotrianisene, and testolactone); nitrogen mustard derivatives (e.g., mephalen, chorambucil, mechlorethamine (nitrogen mustard) and thiotepa); steroids and combinations (e.g., bethamethasone sodium phosphate); and others (e.g., dicarbazine, asparaginase, mitotane, vincristine sulfate, vinblastine sulfate, and etoposide).

In a specific embodiment, antibody and antibody compositions of the invention are administered in combination with CHOP (cyclophosphamide, doxorubicin, vincristine, and prednisone) or any combination of the components of CHOP. In another embodiment, antibody and antibody compositions of the invention are administered in combination with Rituximab. In a further embodiment, antibody and antibody compositions of the invention are administered with Rituxmab and CHOP, or Rituxmab and any combination of the components of CHOP.

In an additional embodiment, the antibody and antibody compositions of the invention are administered in combination with cytokines. Cytokines that may be administered with the antibody and antibody compositions of the invention include, but are not limited to, GM-CSF, G-CSF, IL2, IL3, IL4, IL5, IL6, IL7, IL10, IL12, IL13, IL15, anti-CD40, CD40L, IFN-alpha, IFN-beta, IFN-gamma, TNF-alpha, and TNF-beta. In preferred embodiments, antibody and antibody compositions of the invention are administered with B Lymphocyte Stimulator (e.g., amino acids 134–285 of SEQ ID NO:3228). In another embodiment, antibody and antibody compositions of the invention may be administered with any interleukin, including, but not limited to, IL-1 alpha, IL-1beta, IL-2, IL-3, IL-4, IL-5, IL-6, IL-7, IL-8, IL-9, IL-10, IL-11, IL-12, IL-13, IL-14, IL-15, IL-16, IL-17, IL-18, IL-19, IL-20, IL-21, and IL-22. In preferred embodiments, the antibody and antibody compositions of the invention are administered in combination with IL4 and IL10.

In one embodiment, the antibody and antibody compositions of the invention are administered in combination with one or more chemokines. In specific embodiments, the antibody and antibody compositions of the invention are administered in combination with an $\alpha$(C×C) chemokine selected from the group consisting of gamma-interferon inducible protein-10 ($\gamma$IP-10), interleukin-8 (IL-8), platelet factor-4 (PF4), neutrophil activating protein (NAP-2), GRO-$\alpha$, GRO-$\beta$, GRO-$\gamma$, neutrophil-activating peptide (ENA-78), granulocyte chemoattractant protein-2 (GCP-2), and stromal cell-derived factor-1 (SDF-1, or pre-B cell stimulatory factor (PBSF)); and/or a $\beta$(CC) chemokine selected from the group consisting of: RANTES (regulated on activation, normal T expressed and secreted), macrophage inflammatory protein-1 alpha (MIP-1$\alpha$), macrophage inflammatory protein-1 beta (MIP-1$\beta$), monocyte chemotactic protein-1 (MCP-1), monocyte chemotactic protein-2 (MCP-2), monocyte chemotactic protein-3 (MCP-3), monocyte chemotactic protein-4 (MCP-4) macrophage inflammatory protein-1 gamma (MIP-1$\gamma$), macrophage inflammatory protein-3 alpha (MIP-3$\alpha$), macrophage inflammatory protein-3 beta (MIP-3$\beta$), macrophage inflammatory protein-4 (MIP-4/DC-CK-1/PARC), eotaxin, Exodus, and I-309; and/or the $\gamma$(C) chemokine, lymphotactin.

In another embodiment, the antibody and antibody compositions of the invention are administered with chemokine beta-8, chemokine beta-1, and/or macrophage inflammatory protein-4. In a preferred embodiment, the antibody and antibody compositions of the invention are administered with chemokine beta-8.

In an additional embodiment, the antibody and antibody compositions of the invention are administered in combination with an IL-4 antagonist. IL-4 antagonists that may be administered with the antibody and antibody compositions of the invention include, but are not limited to: soluble IL-4 receptor polypeptides, multimeric forms of soluble IL-4 receptor polypeptides; anti-IL-4 receptor antibodies that bind the IL-4 receptor without transducing the biological signal elicited by IL-4, anti-IL4 antibodies that block binding of IL-4 to one or more IL-4 receptors, and muteins of IL-4 that bind IL-4 receptors but do not transduce the biological signal elicited by IL-4. Preferably, the antibodies employed according to this method are monoclonal antibodies (including antibody fragments, such as, for example, those described herein).

The invention also encompasses combining the polynucleotides and/or polypeptides of the invention (and/or agonists or antagonists thereof) with other proposed or conventional hematopoietic therapies. Thus, for example, the polynucleotides and/or polypeptides of the invention (and/or agonists or antagonists thereof) can be combined with compounds that singly exhibit erythropoietic stimulatory effects, such as erythropoietin, testosterone, progenitor cell stimulators, insulin-like growth factor, prostaglandins, serotonin, cyclic AMP, prolactin, and triiodothyzonine. Also encompassed are combinations of the antibody and antibody compositions of the invention with compounds generally used to treat aplastic anemia, such as, for example, methenolene, stanozolol, and nandrolone; to treat iron-deficiency anemia, such as, for example, iron preparations; to treat malignant anemia, such as, for example, vitamin $B_{12}$ and/or folic acid; and to treat hemolytic anemia, such as, for example, adrenocortical steroids, e.g., corticoids. See e.g., Resegotti et al., Panminerva Medica, 23:243–248 (1981); Kurtz, FEBS Letters, 14a:105–108 (1982); McGonigle et al., Kidney Int., 25:437–444 (1984); and Pavlovic-Kantera, Expt. Hematol., 8(supp. 8) 283–291 (1980), the contents of each of which are hereby incorporated by reference in their entireties.

Compounds that enhance the effects of or synergize with erythropoietin are also useful as adjuvants herein, and include but are not limited to, adrenergic agonists, thyroid hormones, androgens, hepatic erythropoietic factors, erythrotropins, and erythrogenins, See for e.g., Dunn, "Current Concepts in Erythropoiesis", John Wiley and Sons (Chichester, England, 1983); Kalmani, Kidney Int., 22:383–391 (1982); Shahidi, New Eng. J. Med., 289:72–80 (1973); Urabe et al., J. Exp. Med., 149:1314–1325 (1979); Billat et al., Expt. Hematol., 10:133–140 (1982); Naughton et al., Acta Haemat, 69:171–179 (1983); Cognote et al. in abstract 364, Proceedings 7th Intl. Cong. of Endocrinology (Quebec City, Quebec, Jul. 1–7, 1984); and Rothman et al., 1982, J. Surg. Oncol., 20:105–108 (1982). Methods for stimulating hematopoiesis comprise administering a hematopoietically effective amount (i.e., an amount which effects the formation of blood cells) of a pharmaceutical composition containing polynucleotides and/or poylpeptides of the invention (and/or agonists or antagonists thereof) to a patient. The polynucleotides and/or polypeptides of the invention and/or agonists or antagonists thereof is administered to the patient by any suitable technique, including but not limited to, parenteral, sublingual, topical, intrapulmonary and intranasal, and those techniques further discussed herein. The pharmaceutical composition optionally contains one or more members of the group consisting of erythropoietin, testosterone, progenitor cell stimulators, insulin-like growth factor, prostaglandins, serotonin, cyclic AMP, prolactin, triiodothyzonine, methenolene, stanozolol, and nandrolone, iron preparations, vitamin $B_{12}$, folic acid and/or adrenocortical steroids.

In an additional embodiment, the antibody and antibody compositions of the invention are administered in combination with hematopoietic growth factors. Hematopoietic growth factors that may be administered with the antibody and antibody compositions of the invention include, but are not limited to, LEUKINE™ (SARGRAMOSTIN™) and NEUPOGEN™ (FILGRASTIN™).

In an additional embodiment, the antibody and antibody compositions of the invention are administered in combination with fibroblast growth factors. Fibroblast growth factors that may be administered with the antibody and antibody compositions of the invention include, but are not limited to, FGF-1, FGF-2, FGF-3, FGF-4, FGF-5, FGF-6, FGF-7, FGF-8, FGF-9, FGF-10, FGF-11, FGF-12, FGF-13, FGF-14, and FGF-15.

Additionally, the antibody and antibody compositions of the invention may be administered alone or in combination with other therapeutic regimens, including but not limited to, radiation therapy. Such combinatorial therapy may be administered sequentially and/or concomitantly.

Kits

The invention also provides a pharmaceutical pack or kit comprising one or more containers filled with one or more of the ingredients of the pharmaceutical compositions of the invention. Optionally associated with such container(s) can be a notice in the form prescribed by a governmental agency regulating the manufacture, use or sale of pharmaceuticals or biological products, which notice reflects approval by the agency of manufacture, use or sale for human administration.

The present invention provides kits that can be used in the above methods. In one embodiment, a kit comprises an antibody of the invention, preferably a purified antibody, in one or more containers. In an alternative embodiment, a kit comprises an antibody fragment that immunospecifically binds to B Lymphocyte Stimulator. In a specific embodiment, the kits of the present invention contain a substantially isolated B Lymphocyte Stimulator polypeptide as a control. Preferably, the kits of the present invention further comprise a control antibody which does not react with B Lymphocyte Stimulator. In another specific embodiment, the kits of the present invention contain a means for detecting the binding of an antibody to B Lymphocyte Stimulator (e.g., the antibody may be conjugated to a detectable substrate such as a fluorescent compound, an enzymatic substrate, a radioactive compound or a luminescent compound, or a second antibody which recognizes the first antibody may be conjugated to a detectable substrate). In specific embodiments, the kit may include a recombinantly produced or chemically synthesized B Lymphocyte Stimulator. The B Lymphocyte Stimulator provided in the kit may also be attached to a solid support. In a more specific embodiment the detecting means of the above-described kit includes a solid support to which B Lymphocyte Stimulator is attached. Such a kit may also include a non-attached reporter-labeled anti-human antibody. In this embodiment, binding of the antibody to B Lymphocyte Stimulator can be detected by binding of the said reporter-labeled antibody.

In an additional embodiment, the invention includes a diagnostic kit for use in screening serum containing antigens of the polypeptide of the invention. The diagnostic kit includes a substantially isolated antibody specifically immunoreactive with B Lymphocyte Stimulator, and means for detecting the binding of B Lymphocyte Stimulator to the antibody. In one embodiment, the antibody is attached to a solid support. In a specific embodiment, the antibody may be a monoclonal antibody. The detecting means of the kit may include a second, labeled monoclonal antibody. Alternatively, or in addition, the detecting means may include a labeled, competing antigen.

In one diagnostic configuration, test serum is reacted with a solid phase reagent having a surface-bound B Lymphocyte Stimulator obtained by the methods of the present invention. After B Lymphocyte Stimulator binds to a specific antibody, the unbound serum components are removed by washing, reporter-labeled anti-human antibody is added, unbound anti-human antibody is removed by washing, and a reagent is reacted with reporter-labeled anti-human antibody to bind reporter to the reagent in proportion to the amount of bound anti-B Lymphocyte Stimulator antibody on the solid support. Typically, the reporter is an enzyme which is detected by incubating the solid phase in the presence of a suitable fluorometric, luminescent or colorimetric substrate.

The solid surface reagent in the above assay is prepared by known techniques for attaching protein material to solid support material, such as polymeric beads, dip sticks, 96-well plate or filter material. These attachment methods generally include non-specific adsorption of the protein to the support or covalent attachment of the protein, typically through a free amine group, to a chemically reactive group on the solid support, such as an activated carboxyl, hydroxyl, or aldehyde group. Alternatively, streptavidin coated plates can be used in conjunction with biotinylated antigen(s).

Thus, the invention provides an assay system or kit for carrying out this diagnostic method. The kit generally includes a support with surface-bound recombinant B Lymphocyte Stimulator, and a reporter-labeled anti-human antibody for detecting surface-bound anti-B Lymphocyte Stimulator antibody.

In specific embodiments, the present invention encompasses a single chain Fv (scFv) having an amino acid sequence of one of SEQ ID NOS: 1 to 2128.

In specific embodiments, the present invention encompasses a single chain Fv (scFv) having an amino acid sequence of one of SEQ ID NOS: 1 to 46, 321 to 329, 1563 to 1595, and 1881 to 1908.

In specific embodiments, the present invention encompasses a single chain Fv (scFv) having an amino acid sequence of one of SEQ ID NOS: 1563 to 1880.

In specific embodiments, the present invention encompasses a single chain Fv (scFv) having an amino acid sequence of one of SEQ ID NOS: 1881 to 2128.

In specific embodiments, the present invention encompasses a single chain Fv (scFv) having an amino acid sequence of one of SEQ ID NOS: 1 to 1562.

In specific embodiments, the present invention encompasses an antibody or fragment thereof comprising a VH domain from an scFv having an amino acid sequence of one of SEQ ID NOS: 1 to 2128, wherein said antibody or fragment thereof immunospecifically binds B Lymphocyte Stimulator.

In specific embodiments, the present invention encompasses an antibody or fragment thereof comprising a VH domain from an scFv having an amino acid sequence of one of SEQ ID NOS: 1 to 46, 321 to 329, 1563 to 1595, and 1881 to 1908.

In specific embodiments, the present invention encompasses an antibody or fragment thereof comprising a VH domain from an scFv having an amino acid sequence of one of SEQ ID NOS: 1881 to 2128, and in which said antibody or fragment thereof immunospecifically binds to the membrane-bound form of B Lymphocyte Stimulator.

In specific embodiments, the present invention encompasses an antibody or fragment thereof comprising a VH domain from an scFv having an amino acid sequence of one of SEQ ID NOS: 1563 to 1880, and in which said antibody or fragment thereof immunospecifically binds to the soluble form of B Lymphocyte Stimulator.

In specific embodiments, the present invention encompasses an antibody or fragment thereof comprising a VL domain from an scFv having an amino acid sequence of one of SEQ ID NOS: 1 to 2128, wherein said antibody or fragment thereof immunospecifically binds B Lymphocyte Stimulator.

In specific embodiments, the present invention encompasses an antibody or fragment thereof comprising a VL domain from an scFv having an amino acid sequence of one of SEQ ID NOS: 1 to 46, 321 to 329, 1563 to 1595, and 1881 to 1908.

In specific embodiments, the present invention encompasses an antibody or fragment thereof comprising a VL domain from an scFv having an amino acid sequence of one of SEQ ID NOS: 1881 to 2128, and in which said antibody or fragment thereof immunospecifically binds to the membrane-bound form of B Lymphocyte Stimulator.

In specific embodiments, the present invention encompasses an antibody or fragment thereof comprising a VL domain from an scFv having an amino acid sequence of one of SEQ ID NOS: 1563 to 1880, and in which said antibody or fragment thereof immunospecifically binds to the soluble form of B Lymphocyte Stimulator.

In specific embodiments, the present invention encompasses an antibody or fragment thereof comprising a VL domain from an scFv having an amino acid sequence of one of SEQ ID NOS: 1 to 2128, wherein said antibody or fragment thereof immunospecifically binds B Lymphocyte Stimulator and which also comprises a VH domain from an scFv having an amino acid sequence of one of SEQ ID NOS: 1 to 2128.

In specific embodiments, the present invention encompasses an antibody or fragment thereof comprising a VL domain from an scFv having an amino acid sequence of one of SEQ ID NOS: 1 to 2128, wherein said antibody or fragment thereof immunospecifically binds B Lymphocyte Stimulator and which also comprises a VH domain from an scFv having an amino acid sequence of one of SEQ ID NOS: 1 to 2128. and in which said VL and said VH domains are derived from the same scFv having an amino acid sequence of one of SEQ ID NOS: 1 to 2128.

In specific embodiments, the present invention encompasses an antibody or fragment thereof comprising an amino acid sequence of one of SEQ ID NOS: 2129 to 3227 wherein said antibody or fragment thereof immunospecifically binds B Lymphocyte Stimulator.

In specific embodiments, the antibody or fragment thereof of the invention is a whole immunoglobulin molecule.

In specific embodiments, the antibody or fragment thereof of the invention is a Fab fragment.

In specific embodiments, the antibody or fragment thereof of the invention is a Fv fragment.

In specific embodiments, the present invention encompasses a chimeric protein comprising the antibody or fragment thereof of the invention covalently linked to a heterologous polypeptide.

In specific embodiments, the present invention encompasses a composition comprising two or more types of antibodies or fragments or variants thereof, each of which type immunospecifically binds to B Lymphocyte Stimulator, and each of which type of antibody or fragment thereof comprises a VH domain from a different scFv having an amino acid sequence of one of SEQ ID NOS: 1 to 2128.

In specific embodiments, the present invention encompasses a composition comprising two or more types of antibodies or fragments or variants thereof, each of which type immunospecifically binds to B Lymphocyte Stimulator, and each of which type of antibody or fragment thereof comprises a VL domain from a different scFv having an amino acid sequence of one of SEQ ID NOS: 1 to 2128.

In specific embodiments, the present invention encompasses a composition comprising two or more types of antibodies or fragments or variants thereof, each of which type immunospecifically binds to B Lymphocyte Stimulator, and each of which type of antibody or fragment thereof comprises a VL domain from a different scFv having an amino acid sequence of one of SEQ ID NOS: 1 to 2128 and wherein each type of antibody or fragment thereof further comprises a VH domain from a different scFv having an amino acid sequence of one of SEQ ID NOS: 1 to 2128.

In specific embodiments, the present invention encompasses a composition comprising two or more types of antibodies or fragments or variants thereof, each of which type immunospecifically binds to B Lymphocyte Stimulator, and each of which type of antibody or fragment thereof comprises a VH CDR3 having an amino acid sequence of one of SEQ ID NOS: 3129 to 3227.

In specific embodiments, the present invention encompasses a panel of two or more types of antibodies or fragments or variants thereof, each of which type immunospecifically binds to B Lymphocyte Stimulator, and each of which type of antibody or fragment thereof comprises a VH domain from a different scFv having an amino acid sequence of one of SEQ ID NO: 1 to 2128.

In specific embodiments, the present invention encompasses a panel of two or more types of antibodies or fragments or variants thereof, each of which type immunospecifically binds to B Lymphocyte Stimulator, and each of which type of antibody or fragment thereof comprises a VL domain from a different scFv having an amino acid sequence of one of SEQ ID NO: 1 to 2128.

In specific embodiments, the present invention encompasses a panel of two or more types of antibodies or fragments or variants thereof, each of which type immunospecifically binds to B Lymphocyte Stimulator, and each of which type of antibody or fragment thereof comprises a VL domain from a different scFv having an amino acid sequence of one of SEQ ID NO: 1 to 2128 and wherein each type of antibody or fragment further comprises a VH domain from a different scFv having an amino acid sequence of one of SEQ ID NOS: 1 to 2128.

In specific embodiments, the present invention encompasses a panel of two or more antibodies or fragments or variants thereof, each of which type immunospecifically binds to B Lymphocyte Stimulator, and each of which type of antibody or fragment thereof comprises a VHCDR3 from a different scFv having an amino acid sequence of one of SEQ ID NOS: 2129 to 3227.

In specific embodiments, the antibodies or fragments thereof of the antibody panel of the invention, are each in a well of a 96 well plate.

In specific embodiments, the present invention encompasses an isolated nucleic acid molecule comprising a nucleotide sequence encoding an antibody or fragment thereof comprising a VH domain from an scFv having an amino acid sequence of one of SEQ ID NOS: 1 to 2128, wherein said antibody or fragment thereof immunospecifically binds B Lymphocyte Stimulator.

In specific embodiments, the present invention encompasses an isolated nucleic acid molecule comprising a nucleotide sequence encoding an antibody or fragment thereof comprising a VH domain from an scFv having an amino acid sequence of one of SEQ ID NOS: 1 to 46, 321 to 329, 1563 to 1595, and 1881 to 1908, wherein said antibody or fragment thereof immunospecifically binds B Lymphocyte Stimulator.

In specific embodiments, the present invention encompasses an isolated nucleic acid molecule comprising a nucleotide sequence encoding an antibody or fragment thereof comprising a VH domain from an scFv having an amino acid sequence of one of SEQ ID NOS: 1881 to 1908, wherein the antibody of fragment thereof immunospecifically binds the membrane-bound form of B Lymphocyte Stimulator.

In specific embodiments, the present invention encompasses an isolated nucleic acid molecule comprising a nucleotide sequence encoding an antibody or fragment thereof comprising a VH domain from an scFv having an amino acid sequence of one of SEQ ID NOS: 1563 to 1569, wherein said antibody of fragment thereof immunospecifically binds the soluble form of B Lymphocyte Stimulator. The present invention also encompasses vectors comprising the isolated nucleic acid molecule described above, including vectors comprising a nucleotide sequence which regulates the expression of the antibody or fragment thereof encoded by the above-described nucleic acid molecule. Additionally the present invention also encompasses host cells, including mammalian host cells, comprising the above-described nucleic acid molecule which is operably linked to a heterologous promoter, as well as host cells, including mammalian host cells, comprising the above-described vectors. Additionally, the present invention also provides a method for producing an antibody or fragment thereof comprising culturing the above-described host cells under conditions in which the nucleic acid molecule is expressed.

In specific embodiments, the present invention encompasses an isolated nucleic acid molecule comprising a nucleotide sequence encoding an antibody or fragment thereof comprising a VL domain from an scFv having an amino acid sequence of one of SEQ ID NOS: 1 to 2128, wherein said antibody or fragment thereof immunospecifically binds B Lymphocyte Stimulator. The present invention also encompasses vectors comprising the isolated nucleic acid molecule described above, including vectors comprising a nucleotide sequence which regulates the expression of the antibody or fragment thereof encoded by the above-described nucleic acid molecule. Additionally the present invention also encompasses host cells, including mammalian host cells, comprising the above-described nucleic acid molecule which is operably linked to a heterologous promoter, as well as host cells, including mammalian host cells, comprising the above-described vectors. Additionally, the present invention also provides a method for producing an antibody or fragment thereof comprising culturing the above-described host cells under conditions in which the nucleic acid molecule is expressed.

In specific embodiments, the present invention encompasses an isolated nucleic acid molecule comprising a nucleotide sequence encoding an antibody or fragment thereof comprising a VL domain from an scFv having an amino acid sequence of one of SEQ ID NOS: 1 to 46, 321 to 329, 1563 to 1595, and 1881 to 1908, wherein said antibody or fragment thereof immunospecifically binds B Lymphocyte Stimulator. The present invention also encompasses vectors comprising the isolated nucleic acid molecule described above, including vectors comprising a nucleotide sequence which regulates the expression of the antibody or fragment thereof encoded by the above-described nucleic acid molecule. Additionally the present invention also encompasses host cells, including mammalian host cells, comprising the above-described nucleic acid molecule which is operably linked to a heterologous promoter, as well as host cells, including mammalian host cells, comprising the above-described vectors. Additionally, the present invention also provides a method for producing an antibody or fragment thereof comprising culturing the above-described host cells under conditions in which the nucleic acid molecule is expressed.

In specific embodiments, the present invention encompasses an isolated nucleic acid molecule comprising a nucleotide sequence encoding an antibody or fragment thereof comprising a VL domain from an scFv having an amino acid sequence of one of SEQ ID NOS: 1881 to 2128, wherein the antibody of fragment thereof immunospecifically binds the membrane-bound form of B Lymphocyte Stimulator. The present invention also encompasses vectors comprising the isolated nucleic acid molecule described above, including vectors comprising a nucleotide sequence which regulates the expression of the antibody or fragment thereof encoded by the above-described nucleic acid molecule. Additionally the present invention also encompasses host cells, including mammalian host cells, comprising the above-described nucleic acid molecule which is operably linked to a heterologous promoter, as well as host cells, including mammalian host cells, comprising the above-described vectors. Additionally, the present invention also provides a method for producing an antibody or fragment thereof comprising culturing the above-described host cells under conditions in which the nucleic acid molecule is expressed.

In specific embodiments, the present invention encompasses an isolated nucleic acid molecule comprising a nucleotide sequence encoding an antibody or fragment thereof comprising a VL domain from an scFv having an amino acid sequence of one of SEQ ID NOS: 1563 to 1880, wherein said antibody of fragment thereof immunospecifically binds the soluble form of B Lymphocyte Stimulator. The present invention also encompasses vectors comprising the isolated nucleic acid molecule described above, including vectors comprising a nucleotide sequence which regulates the expression of the antibody or fragment thereof encoded by the above-described nucleic acid molecule. Additionally the present invention also encompasses host cells, including mammalian host cells, comprising the above-described nucleic acid molecule which is operably linked to a heterologous promoter, as well as host cells, including mammalian host cells, comprising the above-described vectors. Additionally, the present invention also provides a method for producing an antibody or fragment thereof comprising culturing the above-described host cells under conditions in which the nucleic acid molecule is expressed.

In specific embodiments, the present invention encompasses an isolated nucleic acid molecule comprising a nucleotide sequence encoding an antibody or fragment thereof comprising a VL domain from an scFv having an amino acid sequence of one of SEQ ID NOS: 1 to 2128, wherein said antibody or fragment thereof immunospecifically binds B Lymphocyte Stimulator and which also comprises a VH domain from an scFv having an amino acid sequence of one of SEQ ID NOS: 1 to 2128. The present invention also encompasses vectors comprising the isolated nucleic acid molecule described above, including vectors comprising a nucleotide sequence which regulates the expression of the antibody or fragment thereof encoded by the above-described nucleic acid molecule. Additionally the present invention also encompasses host cells, including mammalian host cells, comprising the above-described nucleic acid molecule which is operably linked to a heterologous promoter, as well as host cells, including mammalian host cells, comprising the above-described vectors. Additionally, the present invention also provides a method for producing an antibody or fragment thereof comprising culturing the above-described host cells under conditions in which the nucleic acid molecule is expressed.

In specific embodiments, the present invention encompasses an isolated nucleic acid molecule comprising a nucleotide sequence encoding an antibody or fragment thereof comprising a VL domain from an scFv having an amino acid sequence of one of SEQ ID NOS: 1 to 2128, wherein said antibody or fragment thereof immunospecifically binds B Lymphocyte Stimulator and which also comprises a VH domain from an scFv having an amino acid sequence of one of SEQ ID NOS: 1 to 2128 and in which said VL domain and said VH domain are derived from the same scFv having an amino acid sequence of one of SEQ ID NOS: 1 to 2128. The present invention also encompasses vectors comprising the isolated nucleic acid molecule described above, including vectors comprising a nucleotide sequence which regulates the expression of the antibody or fragment thereof encoded by the above-described nucleic acid molecule. Additionally the present invention also encompasses host cells, including mammalian host cells, comprising the above-described nucleic acid molecule which is operably linked to a heterologous promoter, as well as host cells, including mammalian host cells, comprising the above-described vectors. Additionally, the present invention also provides a method for producing an antibody or fragment thereof comprising culturing the above-described host cells under conditions in which the nucleic acid molecule is expressed.

In specific embodiments, the present invention encompasses an isolated nucleic acid molecule comprising a nucleotide sequence encoding an antibody or fragment thereof comprising a VHCDR3 from an scFv having an amino acid sequence of one of SEQ ID NOS: 2129 to 3227, wherein said antibody or fragment thereof immunospecifically binds B Lymphocyte Stimulator. The present invention also encompasses vectors comprising the isolated nucleic acid molecule described above, including vectors comprising a nucleotide sequence which regulates the expression of the antibody or fragment thereof encoded by the above-described nucleic acid molecule. Additionally the present invention also encompasses host cells, including mammalian host cells, comprising the above-described nucleic acid molecule which is operably linked to a heterologous promoter, as well as host cells, including mammalian host cells, comprising the above-described vectors. Additionally, the present invention also provides a method for producing an antibody or fragment thereof comprising culturing the above-described host cells under conditions in which the nucleic acid molecule is expressed.

In specific embodiments, the present invention provides an antibody or fragment thereof that immunospecifically binds to B Lymphocyte Stimulator, said antibody or fragment thereof comprising an amino acid sequence of a VH domain encoded by a nucleotide sequence that hybridizes under stringent conditions to a nucleotide sequence encoding a VH domain from an scFv having an amino acid sequence of one of SEQ ID NOS: 1 to 2128.

In specific embodiments, the present invention provides an antibody or fragment thereof that immunospecifically binds to B Lymphocyte Stimulator, said antibody or fragment thereof comprising an amino acid sequence of a VL domain encoded by a nucleotide sequence that hybridizes under stringent conditions to a nucleotide sequence encoding a VL domain from an scFv having an amino acid sequence of one of SEQ ID NOS: 1 to 2128.

In specific embodiments, the present invention provides an antibody or fragment thereof that immunospecifically binds to B Lymphocyte Stimulator, said antibody or fragment thereof comprising an amino acid sequence of a VH domain encoded by a nucleotide sequence that hybridizes under highly stringent conditions to a nucleotide sequence encoding a VH domain from an scFv having an amino acid sequence of one of SEQ ID NOS: 1 to 2128.

In specific embodiments, the present invention provides an antibody or fragment thereof that immunospecifically binds to B Lymphocyte Stimulator, said antibody or fragment thereof comprising an amino acid sequence of a VL domain encoded by a nucleotide sequence that hybridizes under highly stringent conditions to a nucleotide sequence encoding a VL domain from an scFv having an amino acid sequence of one of SEQ ID NOS: 1 to 2128.

In specific embodiments, the present invention provides an antibody or fragment thereof that immunospecifically binds to B Lymphocyte Stimulator, said antibody or fragment thereof comprising an amino acid sequence of a CDR encoded by a nucleotide sequence that hybridizes under stringent conditions to a nucleotide sequence encoding a CDR from an scFv having an amino acid sequence of one of SEQ ID NOS: 1 to 2128.

In specific embodiments, the present invention provides an antibody or fragment thereof that immunospecifically binds to B Lymphocyte Stimulator, said antibody or fragment thereof comprising an amino acid sequence of a CDR encoded by a nucleotide sequence that hybridizes under highly stringent conditions to a nucleotide sequence encoding a CDR from an scFv having an amino acid sequence of one of SEQ ID NOS: 1 to 2128.

In specific embodiments, the present invention provides an antibody or fragment thereof that immunospecifically binds to B Lymphocyte Stimulator, said antibody or fragment thereof comprising an amino acid sequence of a VH CDR3 encoded by a nucleotide sequence that hybridizes under stringent conditions to a nucleotide sequence encoding a VH CDR3 having an amino acid sequence of one of SEQ ID NOS: 2129 to 3227.

In specific embodiments, the present invention provides an antibody or fragment thereof that immunospecifically binds to B Lymphocyte Stimulator, said antibody or fragment thereof comprising an amino acid sequence of a VH CDR3 encoded by a nucleotide sequence that hybridizes under highly stringent conditions to a nucleotide sequence encoding a VH CDR3 having an amino acid sequence of one of SEQ ID NOS: 2129 to 3227.

In specific embodiments, the present invention provides a method for detecting of aberrant expression of B Lymphocyte Stimulator, comprising:

assaying the level of B Lymphocyte Stimulator expression in cells or a tissue sample of an individual using one or more antibodies or fragments or variants thereof that immunospecifically bind B Lymphocyte Stimulator; and comparing the level of B Lymphocyte Stimulator assayed in the cells or a tissue sample with a standard level of B Lymphocyte Stimulator or a level of B Lymphocyte Stimulator in cells or a tissue sample from an individual without aberrant B Lymphocyte Stimulator expression, wherein an increase or decrease in the assayed level of B Lymphocyte Stimulator or level in cells or a tissue sample from an individual without aberrant B Lymphocyte Stimulator expression compared to the standard level of B Lymphocyte Stimulator is indicative of aberrant expression.

In specific embodiments, the present invention provides a method for diagnosing a disease or disorder associated with aberrant B Lymphocyte Stimulator expression or activity, comprising:

administering to a subject an effective amount of a labeled antibody or fragment thereof that immunospecifically binds to B Lymphocyte Stimulator;

waiting for a time interval following the administering for permitting the labeled antibody or fragment thereof to preferentially concentrate at sites in the subject where B Lymphocyte Stimulator is expressed;

determining background level; and detecting the labeled antibody or fragment thereof in the subject, such that detection of labeled antibody or fragment thereof above the background level indicates that the subject has a particular disease or disorder associated with aberrant expression of B Lymphocyte Stimulator.

In specific embodiments, the antibody or fragment thereof utilized in the two methods described immediately above comprises a VH domain from an scFv having an amino acid sequence of one of SEQ ID NOS: 1 to 2128.

In specific embodiments, the antibody or fragment thereof utilized in the two methods described immediately above comprises a VL domain from an scFv having an amino acid sequence of one of SEQ ID NOS: 1 to 2128.

In specific embodiments, the antibody or fragment thereof utilized in the two methods described immediately above comprises a VH CDR3 having an amino acid sequence of one of SEQ ID NOS: 2129 to 3227.

In specific embodiments, the antibody or fragment thereof utilized in the two methods described immediately above is conjugated to a diagnostic agent.

In specific embodiments, the antibody or fragment thereof utilized in the two methods described immediately above is conjugated to a diagnostic agent wherein the diagnostic agent is horseradish peroxidase, alkaline phosphatase, beta-galactosidase, or acetylcholinesterase.

In specific embodiments, the antibody or fragment thereof utilized in the two methods described immediately above is conjugated to a diagnostic agent wherein the diagnostic agent is fluorescein, fluorescein isothiocyanate, rhodamine, dichlorotriazinylamine fluorescein, dansyl chloride or phycoerythrin.

In specific embodiments, the antibody or fragment thereof utilized in the two methods described immediately above is conjugated to a diagnostic agent wherein the diagnostic agent is $^{125}I$, $^{131}I$, $^{111}In$, $^{90}Y$ or $^{99}Tc$.

In specific embodiments, the antibody or fragment thereof utilized in the two methods described immediately above is conjugated to a diagnostic agent wherein the diagnostic agent is luciferase, luciferin or aequorin.

A pharmaceutical composition comprising at least one antibody or fragment thereof of comprising a VH domain from an scFv having an amino acid sequence of one of SEQ ID NOS: 1 to 2128, wherein said antibody or fragment thereof immunospecifically binds B Lymphocyte Stimulator and a pharmaceutically acceptable carrier.

A pharmaceutical composition comprising at least one antibody or fragment thereof of comprising a VL domain from an scFv having an amino acid sequence of one of SEQ ID NOS: 1 to 2128, wherein said antibody or fragment thereof immunospecifically binds B Lymphocyte Stimulator and a pharmaceutically acceptable carrier.

A pharmaceutical composition comprising at least one antibody or fragment thereof of comprising a VL domain from an scFv having an amino acid sequence of one of SEQ ID NOS: 1 to 2128, wherein said antibody or fragment thereof immunospecifically binds B Lymphocyte Stimulator and which also comprises a VH domain from an scFv having an amino acid sequence of one of SEQ ID NOS: 1 to 2128 and a pharmaceutically acceptable carrier.

A pharmaceutical composition comprising at least one antibody or fragment thereof of comprising an amino acid sequence of one of SEQ ID NOS: 2129 to 3227 wherein said antibody or fragment thereof immunospecifically binds B Lymphocyte Stimulator and a pharmaceutically acceptable carrier.

A method of treating, preventing or ameliorating a disease or disorder associated with aberrant B Lymphocyte Stimulator expression or activity, comprising administering to an animal in need thereof the pharmaceutical composition comprising at least one antibody or fragment thereof of comprising a VL domain from an scFv having an amino acid sequence of one of SEQ ID NOS: 1 to 2128, wherein said antibody or fragment thereof immunospecifically binds B Lymphocyte Stimulator and which also comprises a VH domain from an scFv having an amino acid sequence of one of SEQ ID NOS: 1 to 2128 and a pharmaceutically acceptable carrier in an amount effective to treat, prevent or ameliorate the disease or disorder. This method may be used to treat an infectious disorder, cancer, and/or an autoimmune disease such as lupus or glomerular nephritis.

A method of treating, preventing or ameliorating a disease or disorder associated with aberrant B Lymphocyte Stimulator expression or activity, comprising administering to an animal in need thereof the pharmaceutical composition comprising at least one antibody or fragment thereof of comprising a VL domain from an scFv having an amino acid sequence of one of SEQ ID NOS: 1 to 2128, wherein said antibody or fragment thereof immunospecifically binds B Lymphocyte Stimulator and a pharmaceutically acceptable carrier in an amount effective to treat, prevent or ameliorate the disease or disorder. This method may be used to treat an infectious disorder, cancer, and/or an autoimmune disease such as lupus or glomerular nephritis.

A method of treating, preventing or ameliorating a disease or disorder associated with aberrant B Lymphocyte Stimulator expression or activity, comprising administering to an animal in need thereof the pharmaceutical composition comprising at least one antibody or fragment thereof of comprising a VL domain from an scFv having an amino acid sequence of one of SEQ ID NOS: 1 to 2128, wherein said antibody or fragment thereof immunospecifically binds B Lymphocyte Stimulator and which also comprises a VH domain from an scFv having an amino acid sequence of one of SEQ ID NOS: 1 to 2128 and a pharmaceutically acceptable carrier in an amount effective to treat, prevent or ameliorate the disease or disorder. This method may be used to treat an infectious disorder, cancer, and/or an autoimmune disease such as lupus or glomerular nephritis.

A method of treating, preventing or ameliorating a disease or disorder associated with aberrant B Lymphocyte Stimulator expression or activity, comprising administering to an animal in need thereof the pharmaceutical composition of comprising at least one antibody or fragment thereof of comprising an amino acid sequence of one of SEQ ID NOS: 2129 to 3227 wherein said antibody or fragment thereof immunospecifically binds B Lymphocyte Stimulator and a pharmaceutically acceptable carrier in an amount effective to treat, prevent or ameliorate the disease or disorder. This method may be used to treat an infectious disorder, cancer, and/or an autoimmune disease such as lupus or glomerular nephritis.

This method may be used to treat an infectious disorder, cancer, and/or an autoimmune disease such as lupus or glomerular nephritis.

EXAMPLES

Abbreviations 0.2 M Tris-HCl, 0.5 mM EDTA, 0.5 M sucrose (TES)

1-ethyl-3-[3-dimethylaminopropyl]carbo diimide hydrochloride (EDC)

2TY supplemented with 100 µg/ml ampicillin and 2% glucose (2TYAG)

2TY supplemented with 100 µg/ml ampicillin and 50 µg/ml kanamycin (2TYAK)

3,3',5,5'-Tetramethyl Benzidine (TMB)

50% inhibitory concentration ($IC_{50}$)

6×PBS containing 18% Marvel blocking solution (6×MPBS)

Absorbance (A)

Bovine serum albumin (BSA)

Enzyme linked immunosorbent assay (ELISA)

Foetal calf serum (FCS)

Heavy chain variable ($V_H$)

Hepes buffered saline (HBS)

Horseradish peroxidase (HRP)

Immobilised Metal Affinity Chromatography (IMAC)

Isopropyl β-D-thiogalactopyranoside (IPTG)

Light chain variable ($V_L$)

Multiplicity of infection (MOI)

N-[2-hydroxyethyl]piperazine-N'-[2-ethanesulfonic acid] (Hepes)

Nanomolar (nM)

N-Hydroxysuccinimide (NHS)

PBS containing 3% Marvel (MPBS)

Phosphate Buffered Saline (PBS)

Phosphate Buffered Saline+0.1% (v/v) Tween 20 (PBST)

Picomolar (pM)

Single chain fragment variable (scFv)

Tumour Necrosis Factor-alpha (TNF-α)

Tumour Necrosis Factor-beta (TNF-β)

TNF-related apoptosis inducing ligand (TRAIL)

Definitions:

In the following section "immobilized B Lymphocyte Stimulator" refers to a soluble form of B Lymphocyte Stimulator or biotinylated B Lymphocyte Stimulator coated on a plastic assay plate (e.g., a 96 well plate), but does not refer to histidine tagged B Lymphocyte Stimulator coated on a plastic assay plate.; "biotinylated B Lymphocyte Stimulator" is a soluble form of B Lymphocyte Stimulator except when used to coat an ELISA plate, in which case it would be "immobilized B Lymphocyte Stimulator." Membrane bound forms of B Lymphocyte Stimulator include, but are not limited to, U937 and P388 plasma membranes.

Example 1

Antibodies Immunospecifically Binding to Soluble and Membrane-Bound B Lymphocyte Stimulator A library of phage was screened in an assay to identify those phage displaying scFvs that immunospecifically bind to the soluble and membrane-bound forms of B Lymphocyte Stimulator. Phage displaying scFvs that bound to immobilized B Lymphocyte Stimulator were identified after panning on immobilized B Lymphocyte Stimulator and assessment by ELISA for binding to immobilized B Lymphocyte Stimulator. The B Lymphocyte Stimulator that was immobilized on plates for these assays was purified from supernatants of Sf9 cells infected with a baculovirus expression construct as described in Moore et al., Science 285:260–263 which is hereby incorporated by reference in its entirety. Each of the identified scFvs were then sequenced. Certain sequences were isolated multiple times, thus a panel (panel 1) containing one member of each unique sequences was generated and further characterized for their ability to immunospecifically bind to the soluble and membrane-bound forms of B Lymphocyte Stimulator.

The derived amino acid sequences of these scFvs are shown in Table 1 above. The individual $V_H$ and $V_L$ segments of the scFvs were aligned to the known human germline sequences in V-BASE (Tomlinson et al, which can accessed on the United Kingdom Medical Research Council (MRC) Centre for Protein Engineering website) and the closest germline identified.

Example 2

Specificity of scFvs for B Lymphocyte Stimulator and Membrane-Bound B Lymphocyte Stimulator The specificity of each of the scFvs for both B Lymphocyte Stimulator and membrane-bound B Lymphocyte Stimulator was determined by phage ELISA. B Lymphocyte Stimulator was immobilised onto plastic as a purified soluble form of the protein or as a membrane-bound form present on plasma membrane preparations from the human macrophage-like cell line, U937.

Maintenance of U937 Cells

U937 cells are a human monocyte-like, histiocytic lymphoma cell line known to express B Lymphocyte Stimulator on their plasma membranes. They were maintained in RPMI-1640 supplemented with 4 mM L-glutamine, 10% FCS, 10 U penicillin, 100 g/ml streptomycin (all reagents from Sigma). The cells were thawed from frozen stock and are either used for plasma membrane preparation, or split 1:5, after 2 days in culture when the cell density reaches $1\times10^6$/ml.

Preparation of U937 Plasma Membranes

To prepare plasma membranes, $1\times10^9$ U937 cells were harvested from their culture medium by centrifugation at 1000 rpm at 4° C. for 5 minutes in a benchtop centrifuge. The cells were resuspended in 40 ml 12 mM Tris, pH 7.5, 250 mM sucrose and placed on ice. The cells are then lysed using a hand-held electric homogenizer (Labortechnik IKA Ultra-Turrax) for four, one minute, bursts. To check that cell lysis had occurred, 10 μl cell lysate was added to 10 μl Trypan blue and the cell lysate was examined under a microscope. After confirming lysis, the homogenate was centrifuged at 270×g, for 10 minutes at 4° C. to pellet the nuclear fraction and the supernatant was retained. The supernatant was centrifuged at 8000×g, 10 mins, 4° C., to pellet the mitochondrial and lysosomal fractions and the supernatant was retained. The supernatant was then centrifuged at 100000×g, 60 mins, 4° C. to pellet the plasma membrane enriched fraction. The supernatant was discarded and the plasma membrane pellet was resuspended in 1 ml PBS and stored at −70° C. The protein concentration of the plasma membrane fraction was determined using a protein quantification kit (Biorad). Typical yields were between 5 and 10 mg of plasma membranes.

Phage ELISA

To determine the specificity of each of the unique scFvs, a phage ELISA was performed for each scFv against human B Lymphocyte Stimulator, U937 plasma membranes, TNFα (R&D Systems, Minneapolis, Minn.), BSA and uncoated well. Individual *E. coli* colonies containing a phagemid representing one of the unique scFvs from panel 1 were inoculated into 96-well plates containing 100 μl 2TYAG medium per well. Plates were incubated at 37° C. for 4 hours, shaking. M13KO7 helper phage was added to each well to a MOI of 10 and the plates were incubated for a further 1 hour at 37° C. The plates were centrifuged in a benchtop centrifuge at 2000 rpm for 10 minutes. The supernatant was removed and cell pellets were resuspended in 100 μl 2TYAK and incubated at 30° C. overnight, shaking. The next day, plates were centrifuged at 2000 rpm for 10 min and the 100 μl phage-containing supernatant from each well carefully transferred into a fresh 96-well plate. Twenty μl of 6×MPBS was added to each well, and incubated at room temperature for 1 hour to pre-block the phage prior to ELISA.

Flexible 96-well plates (Falcon) were coated overnight at 4° C. with human B Lymphocyte Stimulator (1 μg/ml) in PBS, U937 plasma membranes (10 μg/ml) in PBS, TNFα (1 μg/ml) in PBS, BSA (1 μg/ml) in PBS, or PBS. After coating, the solutions were removed from the wells, and the plates were blocked for 1 hour at room temperature in MPBS. The plates were washed 3 times with PBS and then 50 μl of pre-blocked phage was added to each well. The plates were incubated at room temperature for 1 hour and then washed with 3 changes of PBST followed by 3 changes of PBS. To each well, 50 μl of an anti-gene VIII-HRP conjugate (Pharmacia) at a 1 to 5000 dilution in MPBS was added and the plates incubated at room temperature for 1 hour. Each plate was washed three times with PBST followed by three times with PBS. Then 50 μl of an HRP-labelled anti-mouse polymer (DAKO EnVision) diluted 1/50 in 3% MPBS was added and incubated for 1 hour at room temperature. Each plate was then washed three times with PBST followed by three times with PBS. Fifty μl of TMB substrate was then added to each well, and incubated at room temperature for 30 minutes or until colour development. The reaction was stopped by the addition of 25 μl of 0.5 M $H_2SO_4$. The signal generated was measured by reading the absorbance at 450 nm ($A_{450}$) using a microtiter plate reader (Bio-Rad 3550).

The results for 3 clones (I006E07, I008D05 and I016F04) are shown in FIG. 1. All 3 scFvs recognize immobilized B Lymphocyte Stimulator and U937 plasma membranes but do not recognize TNFα, BSA or an uncoated well (PBS only). These results indicate that these scFvs specifically recognize immobilized B Lymphocyte Stimulator and membrane-bound B Lymphocyte Stimulator.

Example 3

Inhibition in an In Vitro Receptor Binding Assay by Phage ScFvs

All of the unique phage scFvs in panel 1 were assessed for their ability to inhibit soluble B Lymphocyte Stimulator binding to its cognate receptor on IM9 cells.

Biotinylation of B Lymphocyte Stimulator

One hundred μg of either human or mouse B Lymphocyte Stimulator was dialysed overnight at 4° C. against 50 mM sodium bicarbonate (sodium hydrogen carbonate) pH8.5 using a slide-a-lyzer cassette (Pierce). The next day, NHS-biotin (Pierce) was dissolved in DMSO to 13.3 mg/ml. This was then added to the B Lymphocyte Stimulator at a molar ratio of 20:1 biotin:B Lymphocyte Stimulator, mixed and incubated on ice for 2 hours. The biotinylated B Lymphocyte Stimulator was then dialysed back into sterile PBS (Sigma) using a slide-a-lyzer cassette overnight at 4° C. The biological activity of the biotinylated B Lymphocyte Stimulator was confirmed using the receptor binding inhibition assay (see below).

Maintenance of IM9 Cells

IM9 cells are a human B lymphocyte cell line. They were maintained in RPMI-1640 supplemented with 4 mM L-glutamine, 10% FCS, 10 U penicillin, 100 g/ml streptomycin (all reagents from Sigma). The cells are thawed from frozen stock and can be used in assays after 5 days in culture when they reach a density of 4–8×$10^5$/ml.

Receptor Binding Inhibition Assay

Individual *E. coli* colonies containing a phagemid representing one of the unique scFvs from panel 1 were inoculated into 96-well plates containing 100 μl 2TYAG medium per well. Plates were incubated at 37° C. for 4 hours, shaking. M13KO7 helper phage was added to each well to a MOI of 10 and the plates were incubated for a further 1 hour at 37° C. The plates were centrifuged in a benchtop centrifuge at 2000 rpm for 10 minutes. The supernatant was removed and cell pellets were resuspended in 100 μl 2TYAK and incubated at 30° C. overnight, shaking. The next day, plates were centrifuged at 2000 rpm for 10 min and the 100 μl phage-containing supernatant from each well carefully transferred into a fresh 96-well plate. Phage were diluted 1 in 2 in MPBS prior to use.

Flat-bottomed 96-well plates (Costar) were coated with 100 μl per well of a 1:10 dilution of poly-L-lysine (Sigma) in PBS for 1 hour at room temperature. The plates were then washed twice with water, allowed to air-dry and placed at 4° C. overnight. One hundred μl of IM9 cells (at $10^6$/ml in RPMI-1640 culture medium) were then added to each well. Plates were then centrifuged at 3200 rpm for 5 mins to pellet the cells. The media was carefully aspirated and 200 μl of MPBS added to each well. The plates were then allowed to block for 1 hour at room temperature.

To a separate 96-well plate 10 μl of biotinylated B Lymphocyte Stimulator (at 162.5 ng/ml) in MPBS was added to each well to give a final concentration of 25 ng/ml. Fifty-five μl of each appropriate phage supernatant was added to each well and the final volume in each well was 65 μl. Plates were then incubated at room temperature for 30 minutes.

The IM9 coated plates were washed twice in PBS, tapped dry and immediately 50 μl of the phage/biotinylated-B Lymphocyte Stimulator mix was added and incubated at room temperature for 1 hour. Plates were washed three times in PBST and three times in PBS, tapped dry and 50 μl of streptavidin-Delfia (Wallac) was added to each well at 1:1000 dilution in the Manufacturer's assay buffer. The plates were then incubated at room temperature for 1 hour and washed six times in Delfia wash solution (Wallac). After tapping the plates dry, 100 μl per well of Delfia enhancement solution (Wallac) was added. The plates were gently tapped to encourage micelle formation, incubated at room temperature for 10 minutes, and fluorescence read on a Wallac 1420 workstation at 6520 nM.

Results for 3 phage scFvs (I001C09, I018D07 and I016H07) that inhibited the binding of biotinylated B Lymphocyte Stimulator are shown in FIG. 2. Maximal binding of biotinylated B Lymphocyte Stimulator to its receptor (bio-B Lymphocyte Stimulator only), the background signal in the absence of biotinylated B Lymphocyte Stimulator (no bio-B Lymphocyte Stimulator), and results with an irrelevant (i.e., does not recognize B Lymphocyte Stimulator) phage antibody are also shown. All 3 phage scFvs inhibited biotinylated B Lymphocyte Stimulator binding to its receptor on IM9 cells, identifying these scFvs as scFvs that bind the soluble form of B Lymphocyte Stimulator. These scFvs also bind to U937 membranes, thus they also bind the membrane bound form of B Lymphocyte Stimulator.

Forty-eight of the scFvs from panel 1 that demonstrated the greatest inhibition as phage particles in this assay were chosen for further study. These 48 scFvs are listed in Table 3.

TABLE 3 scFvs that Inhibit the Binding of Biotinylated-BLyS to its Receptor

| Antibody | Antibody | Antibody | Antibody | Antibody |
|---|---|---|---|---|
| I008C02 | I029D07 | I008C03 | I008C12 | I028A06 |
| I022E02 | I061E07 | I007H08 | I061H01 | I031C03 |
| I018C02 | I006D07 | I008A11 | I006D08 | I031F02 |
| I008B01 | I017D10 | I061D02 | I026E03 | I031F09 |
| I016F04 | I007B03 | I008A09 | I027A07 | I031G11 |
| I016E05 | I018C10 | I007F11 | I016H07 | I050A07 |
| I0018H08 | I001C09 | I037E07 | I021B05 | I050A12 |
| I018H09 | I018D07 | I037E12 | I031G10 | I050B11 |
| | I029F11 | I016F02 | I031G08 | I051C04 |
| | I022D01 | | I031C07 | I003F12 |
| | | | I012A06 | |

Example 4

Specificity of Anti-B Lymphocyte Stimulator Antibodies

The specificity of the 48 scFvs listed in Table 3 for human and murine B Lymphocyte Stimulator was determined using phage ELISA.

Phage ELISA

To determine the specificity of the 48 scFvs, a phage ELISA was performed against human and mouse B Lymphocyte Stimulator, and a panel of related and unrelated human antigens: Fas ligand, TRAIL, TNFα, TNFβ, and PBS. The: Fas ligand, TRAIL, TNFα, and TNFβ antigens were obtained from R&D Systems, Minneapolis, Minn. Individual *E. coli* colonies containing phagemid were inoculated into 5 ml 2YTAG and incubated at 37° C. for 4 hours, shaking. M13KO7 helper phage (Pharmacia) was added to each tube to a MOI of 10 and incubated for 30 minutes at 37° C. for 1 hour, the first 30 minutes static and the final 30 minutes with gentle shaking. Cells were pelleted by centrifugation at 3,500 rpm for 10 minutes and the supernatant discarded. Cell pellets were resuspended in 5 ml 2TYAK and incubated at 30° C. overnight with shaking. The next day, the cells were pelleted by centrifugation at 3,500 rpm for 10 minutes. The phage-containing supernatant (5 ml) was carefully transferred to a fresh tube, 1 ml of 6MPBS was added, and the tube was incubated at room temperature for 1 hour to pre-block the phage prior to ELISA.

All antigens were coated at 1 μg/ml. ELISAs were performed essentially as described in Example 2. The only exception to this being the detection of phage antibody binding to mouse B Lymphocyte Stimulator where the step involving incubation with the HRP-labelled anti-mouse polymer was omitted. Binding to mouse B Lymphocyte Stimulator was detected with TMB as in Section Example 2.

Figure 3:
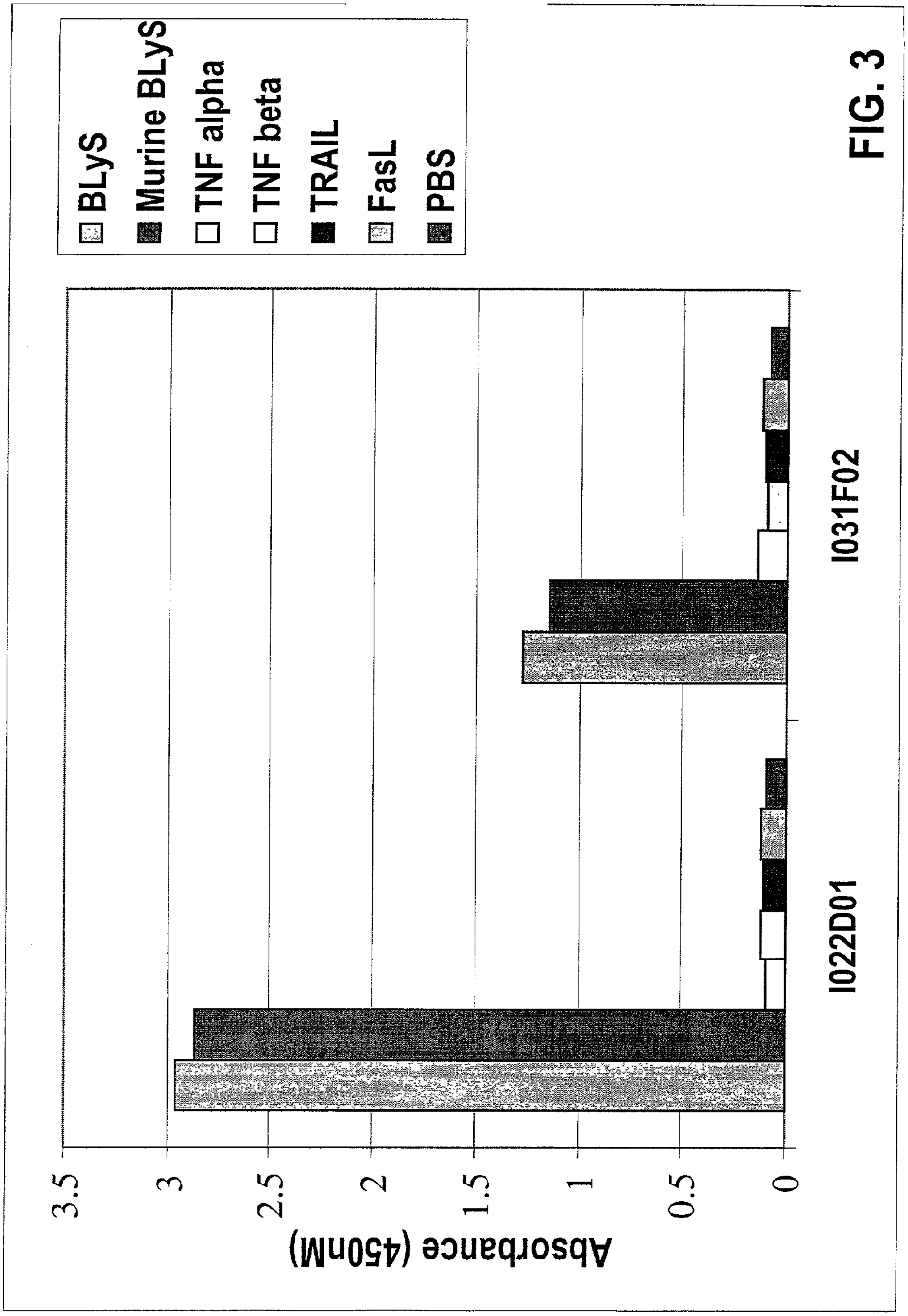
FIG. 3. ELISA results for two scFvs (I022D01 and I031F02) demonstrating their ability to bind to human B Lymphocyte Stimulator and to cross-react with mouse B Lymphocyte Stimulator, but not to bind to or cross-react with other antigens of the TNF ligand family.

All 48 scFvs are specific for immobilized human B Lymphocyte Stimulator and 43 out of the 48 scFvs cross-react with immobilized mouse B Lymphocyte Stimulator but not with any other unrelated or related antigen tested. I008C03, I007F11, I037E07, I037E12, and I016H07 did not bind murine B Lymphocyte Stimulator. Results for two scFvs, I022D01 and I031F02, are shown in FIG. 3. Both these scFvs specifically recognize human and mouse B Lymphocyte Stimulator but not any other unrelated or related antigen tested.

Example 5

Specificity for the Membrane-Bound Form of B Lymphocyte Stimulator

The specificity of 48 scFvs for membrane-bound B Lymphocyte Stimulator was determined by the phage ELISA described in Example 2. B Lymphocyte Stimulator was immobilised onto plastic as a membrane-bound form present on plasma membranes preparations from the human macrophage-like cell line, U937. This cell line is known to express the membrane-bound form of human B Lymphocyte Stimulator.

To demonstrate that this binding is specific for membrane-bound B Lymphocyte Stimulator, a competition ELISA was developed to determine if the ELISA signal for an individual antibody on U937's could be competed out by pre-incubation with either B Lymphocyte Stimulator or TNFα. An anti-B Lymphocyte Stimulator antibody that also recognizes membrane-bound B Lymphocyte Stimulator would be expected to demonstrate a signal reduction with free B Lymphocyte Stimulator but not free TNFα.

Competition ELISA

Individual *E. coli* colonies containing phagemid for each of the 48 scFvs listed in Table 3 were inoculated into 5 ml 2YTAG and incubated at 37° C. for 4 hours, shaking. M13KO7 helper phage (Pharmacia) was added to each tube to a MOI of 10 and incubated for 30 minutes at 37° C. for 1 hour, the first 30 minutes static and the final 30 minutes with gentle shaking. Cells were pelleted by centrifugation at 3,500 rpm for 10 minutes and the supernatant discarded. Cell pellets were resuspended in 5 ml 2TYAK and incubated at 30° C. overnight with shaking. The next day, the cells were pelleted by centrifugation at 3,500 rpm for 10 minutes. The phage-containing supernatants (5 ml) were carefully transferred to a fresh tube.

For each of the 48 scFvs listed in Table 3, two aliquots of 20 μl 6×MPBS were pipetted into separate wells of a 96-well plate (Greiner). The first aliquot was supplemented with B Lymphocyte Stimulator to a final concentration of 0.5 μg/ml. The second aliquot was supplemented with TNF-α to a final concentration of 0.5 μg/ml. Each experiment was performed in triplicate. One hundred μl of each phage supernatant was then added to each aliquot and mixed by pipetting up and down. The phage were incubated (±competing antigen) at room temperature for 1 hour.

Flexible 96-well plates (Falcon) were coated overnight at 4° C. with 50 μl of 10 μg/ml U937 plasma membranes. After coating, the plates were washed 3 times with PBS and blocked for 1 hour at room temperature with 200 μl MPBS. The plates were washed 3 times with PBS and 50 μl of phage (±competing antigen) was added to each appropriate well. The plates were incubated at room temperature for 1 hour and then washed with 3 changes of PBST followed by 3 changes of PBS. To each well, 50 μl of a mouse anti-gene VIII-HRP conjugate (Pharmacia) at a 1:5000 dilution in MPBS was added and the plates incubated at room temperature for 1 hour. Each plate was washed three times with PBST followed by three times with PBS. Then 50 μl of an HRP-labelled anti-mouse polymer (DAKO EnVision) diluted 1:50 in 3% MPBS was added and incubated for 1 hour at room temperature. Each plate was then washed three times with PBST followed by three times with PBS. Fifty μl of TMB substrate was then added to each well, and incubated at room temperature for 30 to 60 minutes or until color development. The reaction was stopped by the addition of 25

μl of 0.5 M $H_2SO_4$. The signal generated was measured by reading the absorbance at 450 nm ($A_{450}$) using a microtiter plate reader (Bio-Rad 3550).

Figure 4:
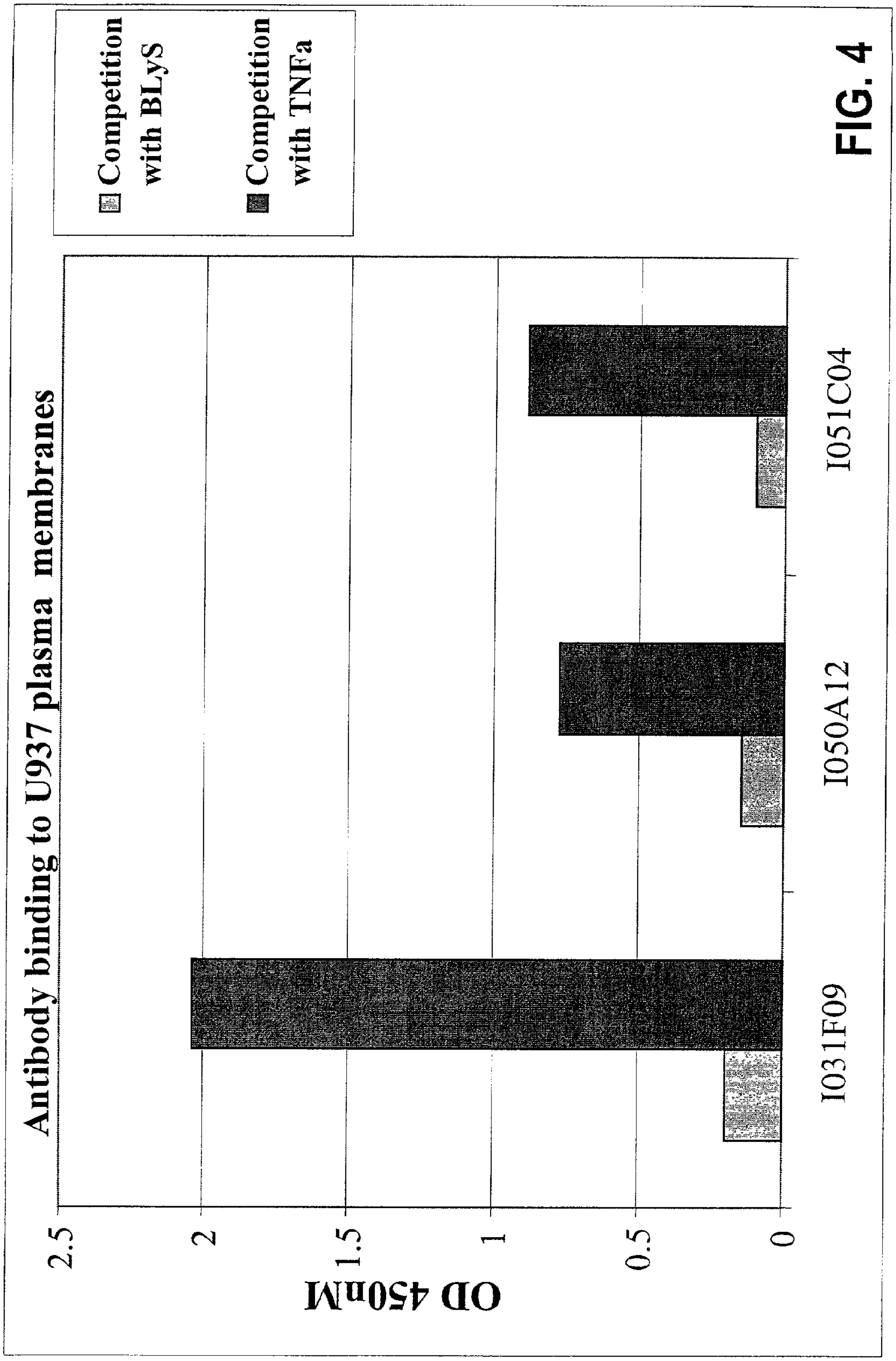
FIG. 4. ELISA results for three scFvs (I031F09, I050A12, and I051C04) binding to U937 plasma membranes when either B Lymphocyte Stimulator or TNF-alpha is used as a competitor.

All 48 scFvs bind to U937 plasma membrane preparations. This signal could be competed out by pre-incubation of the phage antibody with B Lymphocyte Stimulator but not by pre-incubation with TNF-α. This indicates that the 48 scFvs specifically recognize membrane-bound B Lymphocyte Stimulator as well as soluble B Lymphocyte Stimulator. Typical results are exemplified by scFvs I031F09, I050A12 and I051C04 and are shown in FIG. 4. All 3 scFvs demonstrate binding to U937 plasma membranes. This binding was specifically competed out with B Lymphocyte Stimulator but did not compete with TNF-α, demonstrating specific recognition of membrane-bound B Lymphocyte Stimulator.

Example 6 scFv Off-Rate Determinations

All off-rate determinations were performed on BIAcore 2000 machines, using the BIAcore 2000 Control Software and evaluated using the BIAevaluation 3.0 software.

Preparation of a Low Density B Lymphocyte Stimulator Surface

A 500 RU surface was prepared for kinetic studies with purified scFvs. A low density B Lymphocyte Stimulator surface (500 RU B Lymphocyte Stimulator coupled) was prepared in flow cell 2 by amine coupling to a CM5 chip. A new CM5 chip was inserted into the BIAcore and a sensorgram initiated with HBS buffer at a flow rate of 5 μl/min. The NHS and EDC coupling solutions (BIAcore) were mixed according to manufacturer's instructions and 30 μl injected over the CM5 surface. Fifty μl of B Lymphocyte Stimulator at 1 μg/ml in 10 mM sodium acetate buffer, pH4, was then injected followed by 30 μl of ethanolamine-HCl solution (BIAcore). The flow rate was then adjusted to 20 μl/min and 10 μl of 4M guanidine hydrochloride in HBS injected over the surface. This strips the surface of non-covalently bound B Lymphocyte Stimulator.

Measurement of scFv Off-Rate Kinetics on the Low Density Surfaces

The chip containing the low density B Lymphocyte Stimulator surface was inserted in to the BIAcore. A dilution series of purified scFvs was prepared in HBS, typically 50 μg/ml doubling dilutions down to 1.5 ug/ml. The dilution series was then injected sequentially over the low density B Lymphocyte Stimulator surface (and blank control) using the following program:

| | | | |
|---|---|---|---|
| MAIN | | | |
| FLOWCELL 1,2,3,4 | | | |
| APROG | genab | r1d1 | ab1 |
| APROG | genab | r1d2 | ab2 |
| APROG | genab | r1d3 | ab3 |
| APROG | genab | r1d4 | ab4 |
| APROG | genab | r1d5 | ab5 |
| APROG | genab | r1d6 | ab6 |
| APPEND CONTINUE | | | |
| END | | | |
| DEFINE APROG genab | | | |
| PARAM %Abpos %AbId | | | |
| FLOW | 20 | | |
| KINJECT | %Abpos 200 80 | | |

-continued

| | |
|---|---|
| INJECT | r1c6 10!guanidine hydrochloride regeneration step |
| EXTRACLEAN | |
| END | |

Bound scFvs were removed by injecting 10 μl 4M GuHCl in HBS over the surface between scFv samples.

Figure 5:
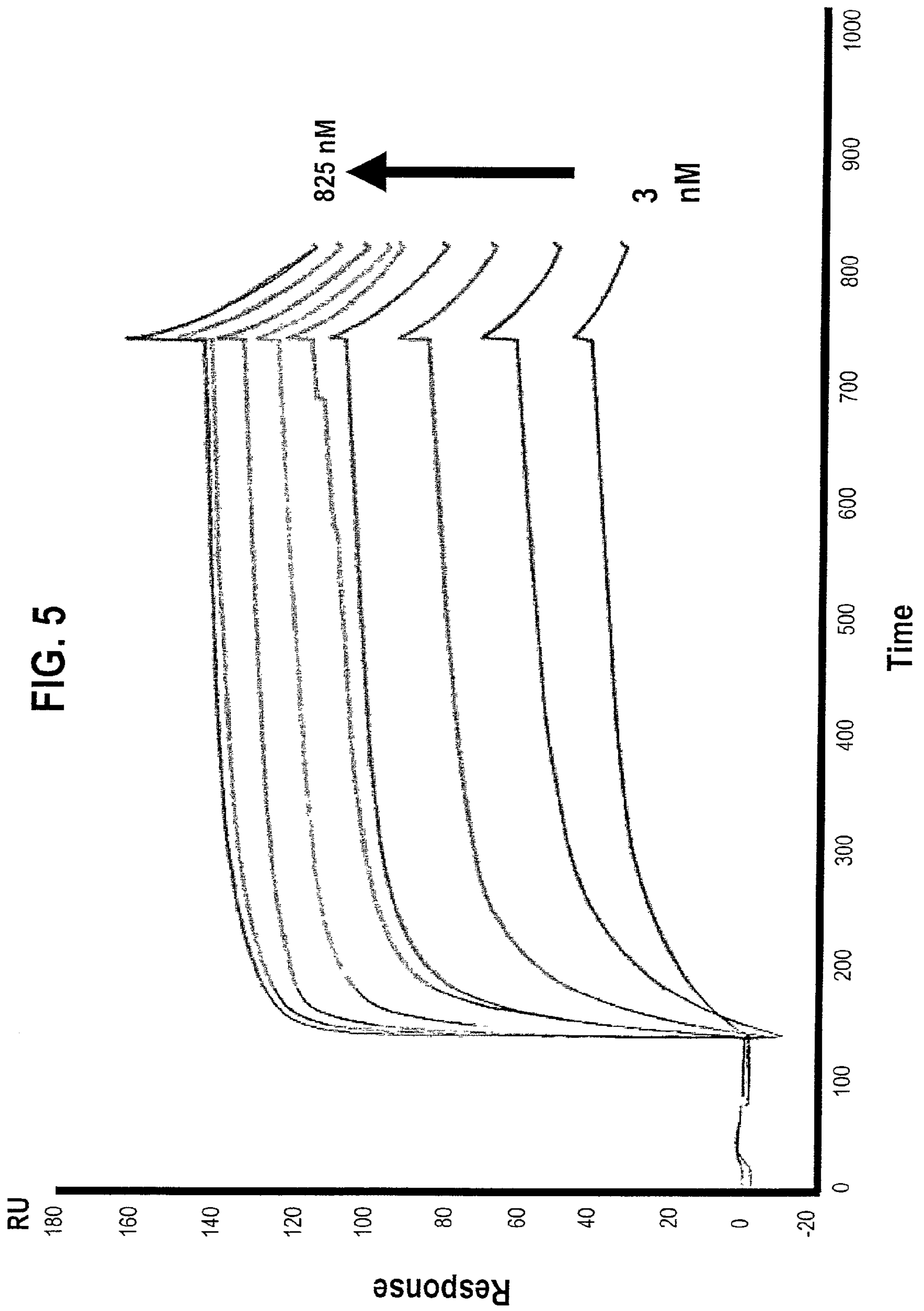
FIG. 5. Kinetic analysis of scFv antibody I003C02. A dilution series of I003C02 from 3 nM to 825 nM is shown. Association and dissociation curves were generated using a BIAcore 2000 and BIAevaluation 3.0 software.

The binding curves for individual scFvs were analyzed using the BIAevaluation software to determine antibody off-rates. Kinetic analysis for a typical scFv antibody, I003C02, is shown in FIG. 5. I003C02 has a $K_{off}=6\times10^{-3}$ $s^{-1}$.

Example 7

Inhibition in an In Vitro Receptor Binding Assay by scFv Antibodies

The 48 scFvs listed in Table 3 were purified and assessed for their ability to inhibit B Lymphocyte Stimulator binding to its receptor on IM9 cells.

Purification of scFv

To determine the inhibitory potency of anti-B Lymphocyte Stimulator scFv, scFv's were first prepared by IMAC. 2TYAG (5 ml) was inoculated with a single colony and grown overnight at 30° C., shaking. This overnight culture was then used to inoculate 500 ml of 2TY containing 100 μg/ml ampicillin and 0.1% Glucose, and grown at 30° C., shaking, until an $A_{600}$ of 1.0 was attained. IPTG was added to 1 mM and the culture was grown for a further 3.5 hours at 30° C.

Cells were harvested by centrifugation at 5,000 rpm, and resuspended in 10 ml of TES. A further 15 ml of a 1:5 dilution (in water) of TES was added, and the cell suspension incubated on a turning wheel at 4° C. for 30 minutes. This causes osmotic shock and yields a periplasmic extract containing the scFv. Residual cells and debris were pelleted by centrifugation at 9,000 rpm for 20 minutes at 4° C. The supernatant was transferred to a new tube, and 50 μl of 1 M $MgCl_2$ added. Two ml of a Ni-NTA agarose (Qiagen), pre-washed with buffer (50 mM sodium phosphate, pH 8, 300 mM NaCl) together with a protease inhibitor tablet (Boehringer Mannheim) were then added to the periplasmic extract. The preparation was incubated, rotating, overnight at 4° C. The Ni-NTA was pelleted by centrifugation at 2,000 rpm for 5 minutes, and the supernatant was aspirated. The agarose beads were washed 3 times with 50 ml wash buffer, centrifuging to collect the agarose in between each wash. Ten ml of wash buffer was added after the final wash, and the slurry was loaded on to a polyprep column (BioRad). Two ml elution buffer (50 mM NaPi (sodium phosphate), pH 8, 300 mM NaCl, 250 mM imidazole) was added to the drained agarose, and the eluate was collected. IMAC purified scFv was buffer exchanged in to PBS by use of a Nap 5 column (Pharmacia) according to the manufacturer's instructions. The $A_{280}$ was read and the protein concentration determined using a molar extinction coefficient of 1 mg/ml protein=$A_{280}$ 1.4. Purified scFv was stored in 500 μl aliquots at −70° C.

Receptor Binding Inhibition Assay

Flat-bottomed 96-well plates (Costar) were coated with 100 μl per well of a 1:10 dilution of poly-L-lysine (Sigma) in PBS for 1 hour at room temperature. The plates were then washed twice with water, allowed to air-dry and placed at 4°

C. overnight. One hundred μl of IM9 cells (at $10^6$/ml in RPMI-1640) were then added to each well. Plates were then centrifuged at 3200 rpm for 5 mins to pellet the cells. The media was carefully aspirated and 200 μl of MPBS added to each well. The plates were then left to block for 1 hour at room temperature.

To a separate 96-well plate, titrate test scFvs in MPBS, in triplicate, over a concentration range from 10 μg/ml down to 0.001 μg/ml were added. The final volume of test scFv in each well was 55 μl. Competition with unlabelled B Lymphocyte Stimulator was also included in every assay as a control. Unlabelled B Lymphocyte Stimulator, in MPBS, was typically titrated in triplicate, over a concentration range from 1 μg/ml down to 0.001 μg/ml. 10 μl of biotinylated-B Lymphocyte Stimulator (at 162.5 ng/ml) in MPBS was added to each well to give a final concentration of 25 ng/ml. Plates were then incubated at room temperature for 30 minutes.

The IM9 coated plates was washed twice in PBS, tapped dry and immediately 50 μl of the scFv/biotinylated-B Lymphocyte Stimulator mix was added and incubated at room temperature for 1 hour. Plates were washed three times in PBST and three times in PBS, tapped dry and 50 μl per well added of streptavidin-Delfia (Wallac) at 1:1000 dilution in the Manufacturer's assay buffer. The plates were then incubated at room temperature for 1 hour and washed six times in Delfia wash solution (Wallac). After tapping the plates dry, 100 μl per well of Delfia enhancement solution (Wallac) was added. The plates were gently tapped to encourage micelle formation, incubated at room temperature for 10 minutes, and fluorescence read on a Wallac 1420 workstation at 6520 nM.

Figure 6:
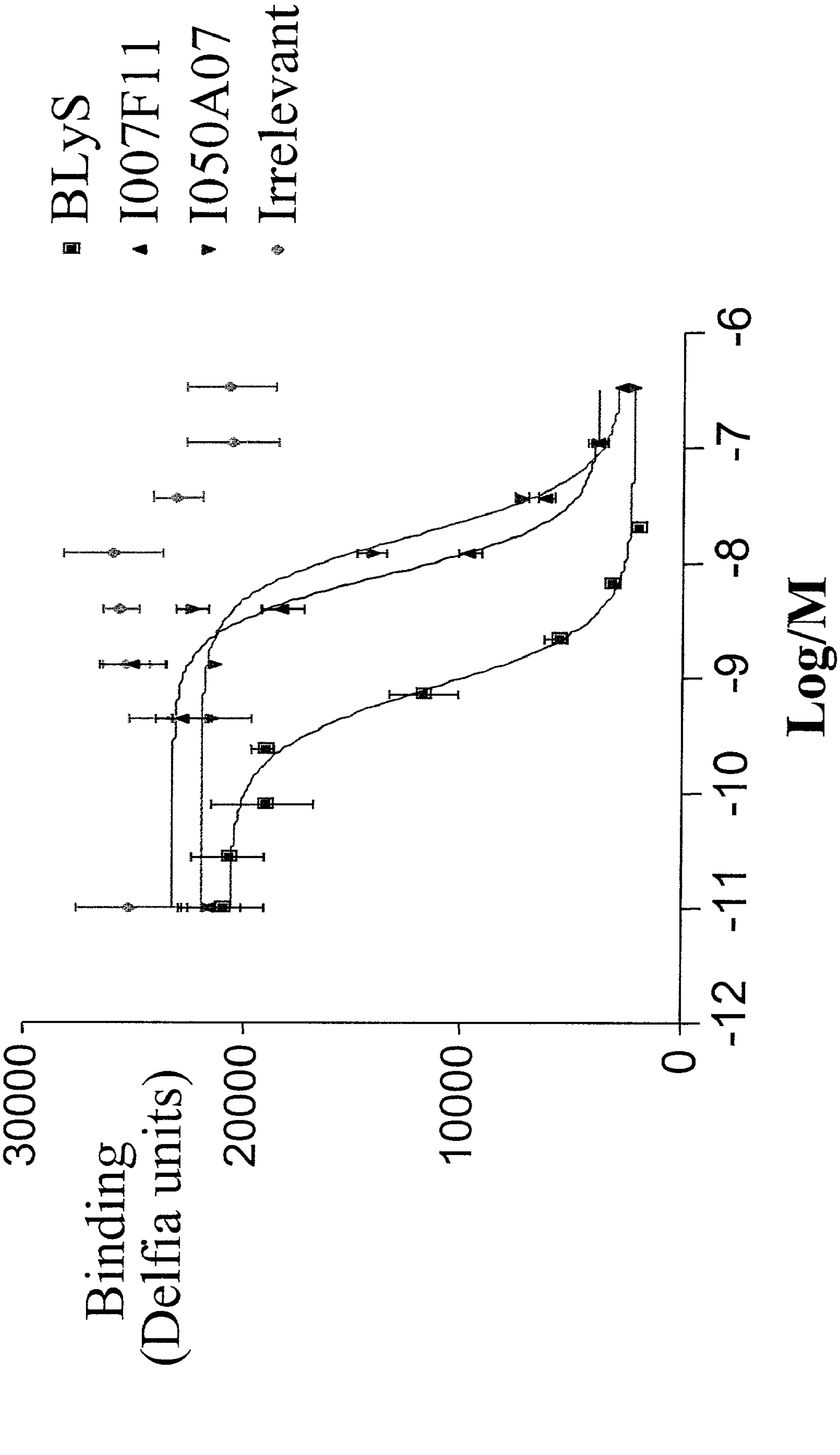
FIG. 6. Typical titration curves for two scFv antibodies (I007F11 and I050A07) are shown in FIG. 6. Unlabelled B Lymphocyte Stimulator competed for binding to its receptor with an $IC_{50}$ value of 0.8 nM. The $IC_{50}$ values for I007F11 and I050A07 are 7.9 nM and 17.1 nM, respectively. The assay was performed in triplicate and standard error bars are shown.

Typical titration curves for two scFv antibodies, I007F11 and I050A07, are shown in FIG. 6. Unlabelled B Lymphocyte Stimulator competed for binding to its receptor with an $IC_{50}$ value of 0.8 nM. The $IC_{50}$ values for I007F11 and I050A07 are 7.9 nM and 17.1 nM, respectively. The assay was performed in triplicate and standard error bars are shown. The 9 scFvs that demonstrated the greatest inhibition as scFv are listed in Table 4. This data also confirms that these 9 scFvs recognize the soluble form of B Lymphocyte Stimulator.

TABLE 4

ScFvs that demonstrated greatest potency in BLyS Receptor Binding Inhibition Assay

| ScFv Antibody |
|---|
| I017D10 |
| I022D01 |
| I008A11 |
| I006D08 |
| I031F02 |
| I050A12 |
| I050B11 |
| I051C04 |
| I003F12S |

Example 8

Antibodies Recognizing a Soluble Form of B Lymphocyte Stimulator

A library of phage was screened in an assay to identify those phage displaying scFvs that immunospecifically bind to the soluble but not the membrane-bound forms of B Lymphocyte Stimulator.

A phage library was screened for the ability to bind to biotinylated B Lymphocyte Stimulator. The phage were exposed to biotinylated B Lymphocyte Stimulator, allowed an interval of time to bind the biotinylated B Lymphocyte Stimulator. Phage binding bio-B Lymphocyte Stimulator were then isolated by capture on streptavidin coated magnetic beads.

The phage identified in the screen above (capture of Bio-B Lymphocyte Stimulator from solution) were then screened by ELISA for their ability to bind immobilized B Lymphocyte Stimulator. The scFv expressed by phage that bound immobilized B Lymphocyte Stimulator were then cloned and sequenced. Again, several sequences were identified multiple times, thus a panel (panel 2) consisting of on example of each phage expressing a unique scFv was then characterized further.

The derived amino acid sequences of these scFvs are shown in Table 1 above. The individual $V_H$ and $V_L$ segments of the scFvs were aligned to the known human germline sequences in V-BASE (Tomlinson et al, which can accessed on the United Kingdom Medical Research Council (MRC) Centre for Protein Engineering website) and the closest germline identified.

Example 9

Specificity For Soluble B Lymphocyte Stimulator

The scFvs were isolated from a library of phage based on their ability to bind a soluble form of B Lymphocyte Stimulator. Briefly, phage were preincubated with biotinylated B Lymphocyte Stimulator in solution. Phage that bound to this biotinylated B Lymphocyte Stimulator were then isolated using streptavidin coated magnetic beads.

The specificity of each of the unique scFvs for B Lymphocyte Stimulator and for the membrane-bound form of B Lymphocyte Stimulator, was determined by phage ELISA. B Lymphocyte Stimulator was immobilised onto plastic as a purified soluble form of the protein or as a membrane-bound form present on plasma membrane preparations from the human macrophage-like cell line, U937. Maintenance of U937 cells and plasma membrane preparations were performed as detailed in Example 2.

Phage ELISA

To determine the specificity of each of the scFvs, a phage ELISA was performed for each antibody against human B Lymphocyte Stimulator, U937 plasma membranes, TNFα, BSA and an uncoated well. Antigen coating conditions were as described in Example 2, apart from human B Lymphocyte Stimulator. B Lymphocyte Stimulator was first biotinylated (as described in Example 3) and coated at 1 μg/ml onto streptavidin coated plates (Reacti-Bind, Pierce) for 30 mins at room temperature. The plates were then washed, blocked and the phage ELISA performed as detailed in Example 2.

The results for 3 clones (I074B12, I075F12 and I075A02) that bind the soluble but not the membrane-bound form of B Lymphocyte Stimulator are shown in FIG. 7. As a control, a phage antibody that recognizes TNFα, is also shown in FIG. 7. There is a small non-specific background signal on the U937 plasma membranes that is evident with both the anti-B Lymphocyte Stimulator scFvs as well as the anti-TNFα control. All 3 anti-B Lymphocyte Stimulator scFvs recognize B Lymphocyte Stimulator but not U937 plasma membranes, TNFα, BSA or an uncoated well (PBS only). This indicates that the scFvs do not bind the membrane-bound form of B Lymphocyte Stimulator. Further, The fact that these scFvs were isolated on the basis of their ability to bind soluble biotinylated B Lymphocyte Stimulator indicates that they bind the soluble form of B Lymphocyte Stimulator. Further confirmation of these scFvs' specificity for B Lymphocyte Stimulator is provided in Example 10.

Example 10

Inhibition in an In Vitro Receptor Binding Assay by Phage scFvs

All of the unique phage scFvs from panel 2 were assessed for their ability to inhibit B Lymphocyte Stimulator binding to its cognate receptor on IM9 cells. The biotinylation of B Lymphocyte Stimulator, maintenance of IM9 cells and receptor binding inhibition assay were performed as described in Example 3.

Figure 8:
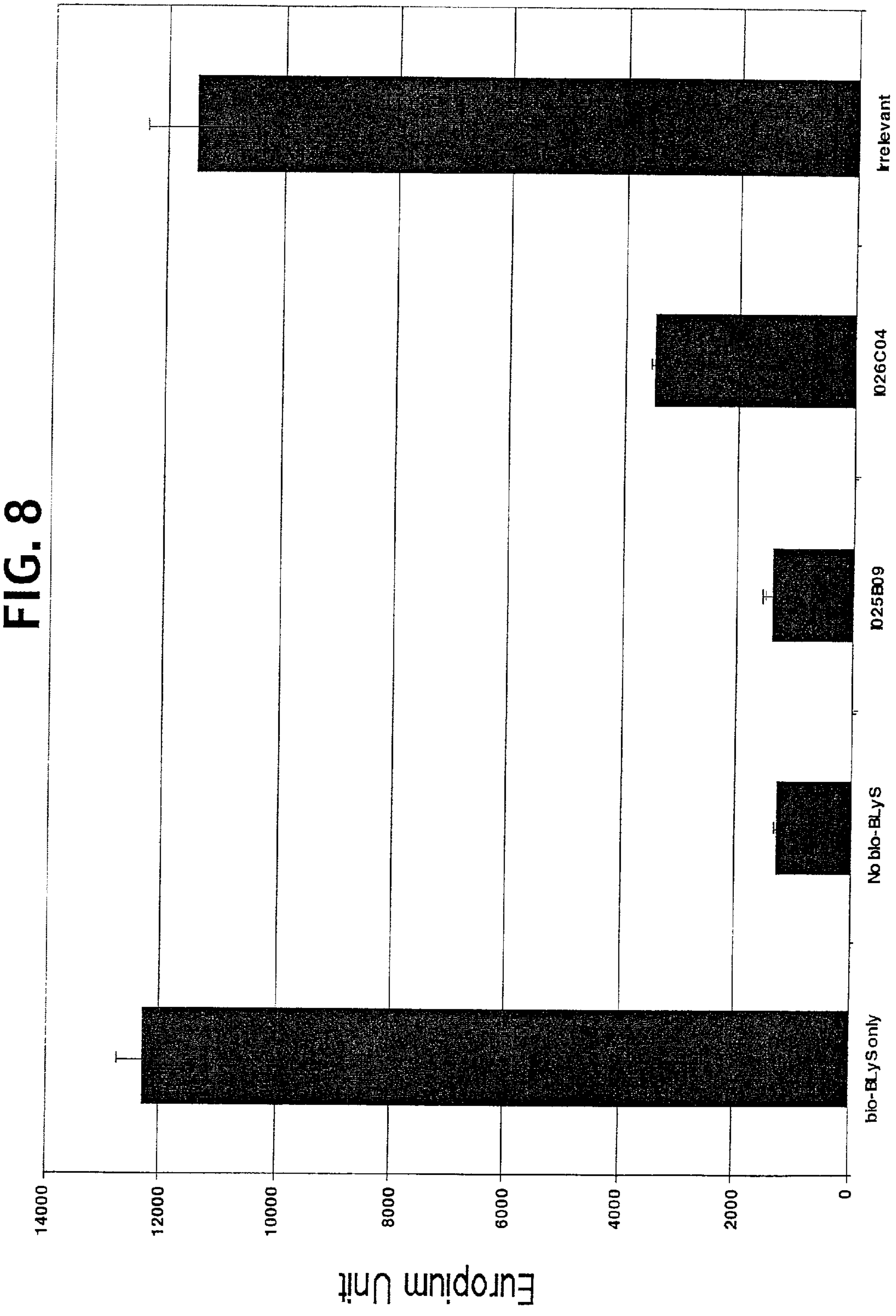
FIG. 8. The results for two scFvs (I025B09 and I026C04) in a receptor inhibition assay.

Results for two phage scFvs, I0025B09 and I026C04 are shown in FIG. 8. Maximal binding of biotinylated B Lymphocyte Stimulator to its receptor (bio-B Lymphocyte Stimulator only), the background signal in the absence of biotinylated B Lymphocyte Stimulator (no bio-B Lymphocyte Stimulator), and results with an irrelevant (i.e. does not recognize B Lymphocyte Stimulator) phage antibody are also shown. Both phage scFvs inhibited biotinylated B Lymphocyte Stimulator binding to its receptor on IM9 cells. 33 of the unique scFvs from panel 2 were identified for further study. These 33 scFvs demonstrated the greatest inhibition as phage particles in this assay and are listed in Table 5.

TABLE 5

Identification of 33 phage scFvs to free BLyS that demonstrates the most significant inhibition of biotinylated-BLyS binding to its receptor

| Antibody | Antibody | Antibody | Antibody |
|---|---|---|---|
| I026C04 | I074B12 | I073F04 | I065D04 |
| I003C06 | I075A02 | I078D08 | I068C08 |
| I025B09 | I068B08 | I078D02 | I068F03 |
| I027B12 | I068B04 | I075G01 | I069B07 |
| I025B06 | I068C06 | I071B03 | |
| I030A10 | I075F12 | I072B09 | |
| I002A01R | I065D08 | I078H08 | |
| I002A01K | I065F08 | I064C04 | |
| I026C04R | I067B10 | I064C07 | |
| I026C04K | I067F05 | | |

Example 11

Specificity of Anti-B Lymphocyte Stimulator scFvs

The specificity of the 33 scFvs (listed in Table 5) for immobilized human and murine B Lymphocyte Stimulator was determined using phage ELISA.

Phage ELISA

To determine the specificity of the 33 scFvs, a phage ELISA was performed as described in Example 4 against human and mouse B Lymphocyte Stimulator, and a panel of related human antigens: TRAIL, LIGHT, TNFα, TNFβ, and an uncoated well (PBS only).

Figure 9:
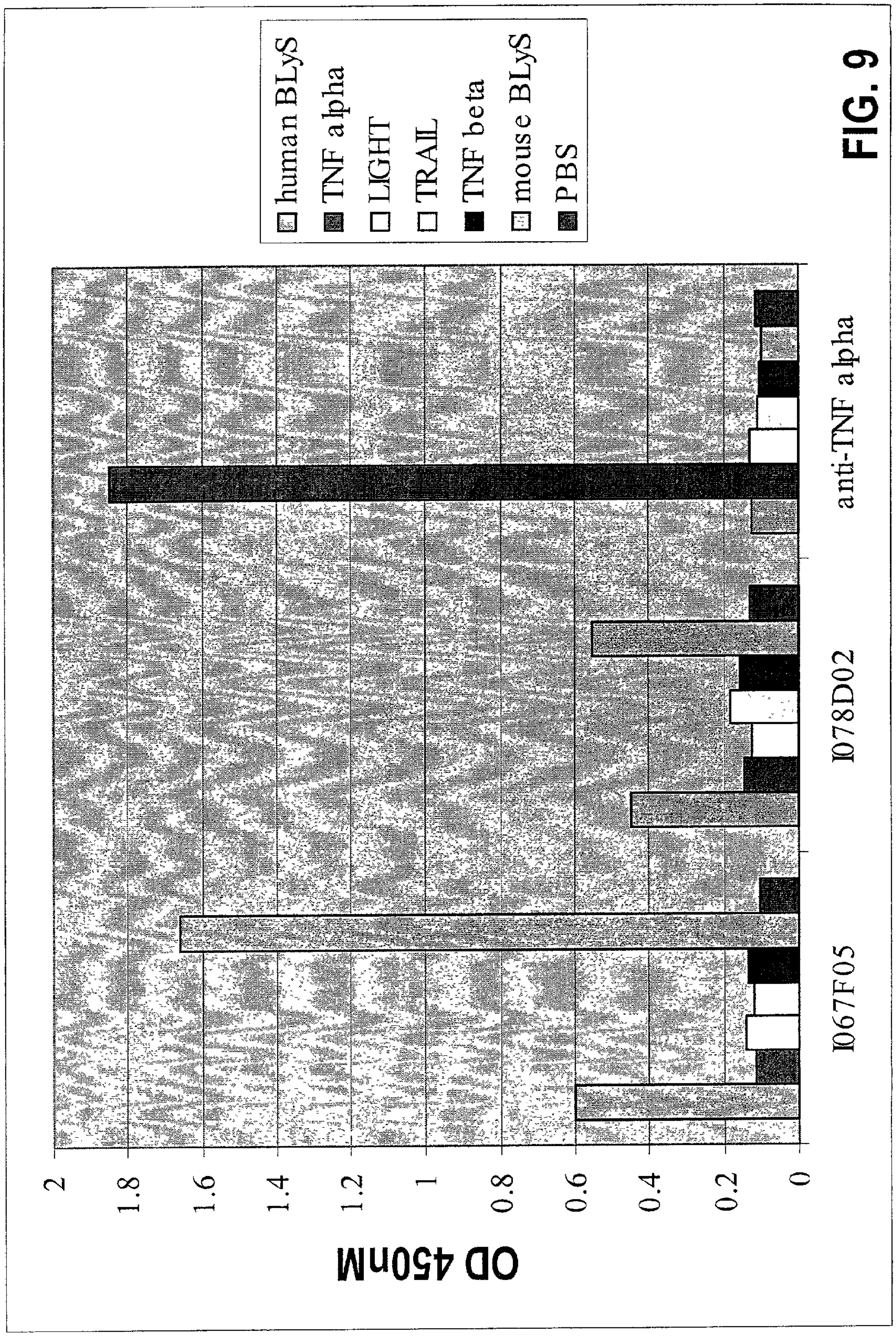
FIG. 9. ELISA results for two scFvs clones (I067F05 and I078D02) demonstrating their ability to bind to immobilized human B Lymphocyte Stimulator and to cross-react with immobilized mouse B Lymphocyte Stimulator, but not to bind to or cross-react with other antigens of the TNF ligand family.

Typical results for two scFvs, I067F05 and I078D02 are shown in FIG. 9. A control antibody that specifically recognizes TNFα is also shown. Both anti-B Lymphocyte Stimulator scFvs specifically recognize immobilized human and mouse B Lymphocyte Stimulator but not any other antigen tested.

All 33 scFvs are specific for human B Lymphocyte Stimulator. 14/33 cross-react with mouse B Lymphocyte Stimulator but not with any other unrelated or related antigen tested.

Example 12 scFv Off-Rate Determinations

Off-rate determinations, preparation of a low density B Lymphocyte Stimulator surface and kinetic measurements were as detailed in Example 6.

The binding curves for individual scFvs were analysed using the BIAevaluation software to determine antibody off-rates. Kinetic analysis for a typical scFv antibody, I002A01, is shown in FIG. 10. I002A01 has a $K_{off}$=9×$10^{-4}$ $s^{-1}$.

Example 13

Inhibition in an In Vitro Receptor Binding Assay by scFv Antibodies

The 33 scFvs identified in Table 5 were prepared as purified scFvs and assessed for their ability to inhibit B Lymphocyte Stimulator binding to its receptor on IM9 cells. The scFvs were purified and analysed in the receptor binding inhibition assay as described in Example 6.1.8.

Typical titration curves for two scFvs, I0068C06 and I074B12, are shown in FIG. 11. Unlabelled B Lymphocyte Stimulator competed for binding to its receptor with an inhibitory constant 50 ($IC_{50}$) value of 0.66 nM. The $IC_{50}$ values for I0068C06 and I074B12 are 61 nM and 13 nM, respectively. The assay was performed in triplicate and standard error bars are shown. The 7 scFvs that demonstrated the greatest inhibition as scFv are listed in Table 6.

TABLE 6

Identification of 7 scFvs to free BLyS that demonstrate the most significant inhibition of biotinylated-BLyS binding to its receptor as purified scFv's.

| Antibody |
|---|
| I002A01-R |
| I002A01-K |
| I026C04-R |
| I026C04-K |
| I068C06 |
| I075F12 |
| I067B10 |

Example 14

ScFvs Recognizing Membrane-Bound B Lymphocyte Stimulator

A library of phage was screened in an assay to identify those phage displaying scFvs that immunospecifically bind to the membrane-bound but not the soluble form of B Lymphocyte Stimulator.

As a starting point, a library of phage expressing scFv antibodies were panned on immobilized HIS-tagged B Lymphocyte Stimulator. Phage isolated by panning were then screened for the ability to bind to HIS-tagged B Lymphocyte Stimulator. HIS-tagged B Lymphocyte Stimulator was obtained by expressing amino acids 71–285 of SEQ ID NO:3228 using the pQE9 vector (Qiagen Inc., Valencia, Calif.) in *E. coli* and purifying the expressed protein. This phage clones identified by this screen were then sequenced. After sequencing, A panel (panel 3) of phage each expressing a unique scFv that bound HIS-tagged B Lymphocyte Stimulator was generated and further characterized.

The derived amino acid sequences of the unique scFvs from panel 3 are shown in Table 1 above. The individual $V_H$ and $V_L$ segments of the scFvs were aligned to the known human germline sequences in V-BASE (Tomlinson et al, which can accessed on the United Kingdom Medical Research Council (MRC) Centre for Protein Engineering website) and the closest germline identified.

Example 15

Recognition of Membrane-Bound B Lymphocyte Stimulator

The specificity of each of the unique scFvs for both the membrane-bound form of B Lymphocyte Stimulator as well as for the soluble form of B Lymphocyte Stimulator, was determined by phage ELISA.

B Lymphocyte Stimulator was immobilised onto plastic either directly as a purified soluble form of the protein or biotinylated and coated on a streptavidin plate as in Example 9. Binding to HIS-tagged B Lymphocyte Stimulator was used as a primary screen for scFv's that would bind the membrane-bound form of B Lymphocyte Stimulator (see below). The membrane-bound form of B Lymphocyte Stimulator was presented as plasma membranes preparations from the human macrophage-like cell line, U937 or the murine cell line P388.

Mouse monoclonal antibodies have been raised against His-tagged B Lymphocyte Stimulator according to standard procedures. Characterization of these mouse monoclonal antibodies revealed that they specifically recognized both His-tagged B Lymphocyte Stimulator and the membrane-bound form of B Lymphocyte Stimulator on U937 cells, but not soluble B Lymphocyte Stimulator. Therefore, specific recognition of His-tagged B Lymphocyte Stimulator was used as supporting evidence for the recognition of the membrane-bound form of B Lymphocyte Stimulator by phage and scFv antibodies.

Phage ELISA

To determine the specificity of each of the scFvs, a phage ELISA was performed for each antibody against His-tagged human B Lymphocyte Stimulator, U937 plasma membranes, TNFα, BSA and an uncoated well. Antigen coating conditions were as described in 2. apart from human B Lymphocyte Stimulator. B Lymphocyte Stimulator was first biotinylated (as described in Example 3) and coated at 1 μg/ml onto streptavidin coated plates (Reacti-Bind, Pierce) for 30 mins at room temperature. The plates were then washed, blocked and the phage ELISA performed as detailed in Example 2.

The results for 3 clones, I079C01, I081C10 and I082A02, and a control phage antibody that recognizes TNFα, are shown in FIG. 12. All 3 scFvs recognize U937 plasma membranes (U937) and His-tagged B Lymphocyte Stimulator (HIS-B Lymphocyte Stimulator) but not, biotinylated B Lymphocyte Stimulator (bio-B Lymphocyte Stimulator) or an uncoated well (PBS). This indicates that the scFvs recognize the membrane-bound form of B Lymphocyte Stimulator.

Example 16

Specificity for Membrane-Bound B Lymphocyte Stimulator

The specificity of the scFvs for only the membrane-bound form of B Lymphocyte Stimulator, and not for the soluble form, was confirmed using a competition ELISA. This assay assesses the ability of test phage scFvs to bind to the membrane-bound form of B Lymphocyte Stimulator on U937 plasma membranes in the presence of different forms of competing B Lymphocyte Stimulator. Competing B Lymphocyte Stimulator was either the His-tagged form of B Lymphocyte Stimulator or soluble B Lymphocyte Stimulator. ScFvs specific for the membrane-bound B Lymphocyte Stimulator would be expected to be competed out by pre-incubation with His-tagged B Lymphocyte Stimulator but not by pre-incubation with soluble B Lymphocyte Stimulator.

Maintenance of U937 cells and plasma membrane preparations were performed as detailed in Example 2.

Competition ELISA

U937 plasma membranes (50 μl per well) were coated at 10 μg/ml in PBS onto Falcon 96-well plates overnight at 4° C.

Individual *E. coli* colonies containing a phagemid representing one of the unique scFvs from the panel 3 were inoculated into 50 ml tubes (Falcon) containing 5 ml 2TYAG medium. Tubes were incubated at 37° C. for 4 hours, shaking. M13KO7 helper phage was added to each tube to an MOI of 10 and the tubes were incubated for a further 1 hour at 37° C. The tubes were centrifuged in a benchtop centrifuge at 3500 rpm for 10 minutes. The supernatant was removed and cell pellets were resuspended in 5 ml 2TYAK and incubated at 30° C. overnight, shaking. The next day, tubes were centrifuged at 3500 rpm for 10 min and the phage-containing supernatant carefully transferred into a fresh tube.

For each test phage antibody, 3 aliquots of 20 μl 18% marvel/6×PBS were transferred into separate wells of a 96-well plate. The first aliquot was supplemented with His-tagged B Lymphocyte Stimulator to a final concentration of 60 μg/ml. The second aliquot was supplemented with soluble B Lymphocyte Stimulator to a final concentration of 60 μg/ml. The third aliquot was not supplemented with any competing antigen. One hundred μl of phage supernatant was then added to each aliquot and left to block at room temperature for 1 hour.

The antigen-coated plates were washed once with PBS before the addition of 200 μl/well 3% marvel/PBS. These plates were left to block at 37° C. for 1 hour and were then washed once with PBS. Duplicate samples of 50 μl pre-blocked phage (above) were added to the antigen-coated plates and left at room temperature for 1 hour. Plates were washed 3× with PBS/0.1% Tween 20, then 3× with PBS. Fifty μl/well mouse anti-M13 HRP (Pharmacia) at 1/5000 in 3% Marvel/PBS was added and left for 1 hour at room temperature. Plates were washed 3 times with PBS/0.1% Tween 20, then 3 times with PBS. Fifty μl/well HRP-labelled anti-mouse Envision polymer (DAKO) at 1/50 in 3% marvel/PBS was added and left for 1 hour at RT. Plates were washed 3 times with PBS/0.1% Tween 20, then 3 times with PBS. Next, 50 μl/well of TMB (Sigma) was added and plates left to develop for 30 to 60 minutes. When sufficient color has developed, 25 μl/well 0.5M $H_2SO_4$ was added to stop the reaction. The plates were read at 450 nm on a microtiter plate reader (Bio-Rad 3550).

The results for 3 clones, I079B04, I079F08 and I080B01, and a control phage antibody that recognizes TNFα, are shown in FIG. 13. All 3 scFvs recognize U937 plasma membranes (U937). This binding is competed out to background levels (i.e. comparable to the signal observed with the anti-TNFα phage antibody) in the presence of His-tagged B Lymphocyte Stimulator (HIS-B Lymphocyte Stimulator) but not biotinylated B Lymphocyte Stimulator (bio-B Lymphocyte Stimulator). This confirms that the scFvs specifically recognize the membrane-bound form but not the soluble form of B Lymphocyte Stimulator.

Example 17

High Throughput BIAcore Screen to Identify High Affinity scFvs

This is a 96-well screen where the test samples (scFvs) are derived from 1 ml periplasmic extracts of individual antibody expressing clones. Potentially higher affinity scFvs are then identified principally as those giving a large number of total RU's bound to a HIS-B Lymphocyte Stimulator surface in BIAcore. This method of ranking does assume approximately equal yields of scFv from each clone. Since this is not always the case, some scFvs may also be identified that simply express high levels of scFv. These can be discriminated from those of higher affinity by further characterization of the scFvs (see Example 18).

Preparation of ScFv from 1 ml *E. coli* Cultures

Individual *E. coli* colonies containing a phagemid representing one of the unique scFvs from panel 3 were inoculated into 96-well plates containing 100 μl 2TYAG medium per well. Eight wells on each plate were reserved for positive and negative control samples. The plate was grown overnight at 30° C. with shaking at 120 rpm.

Next day, 1 ml of 2TYAG+345 mM sucrose was added to each well of an autoclaved 96 deep well plate (Beckman). Twenty μl of each overnight culture was resuspended and transferred to the appropriate well of the deep well plate. The plate was grown for approximately 3.5 hours at 30° C. with shaking at 250 rpm (or until the $OD_{600}$=0.6). Fifty μl of 1M IPTG was added to 5 ml 2TY and 10 μl of this was added to each well. The plate was grown overnight at 30° C. with shaking at 250 rpm.

Plates were kept at 4° C. for the remainder of the procedure. The overnight plate (above) was centrifuged at 3500 rpm for 10 minutes at 4° C. to pellet the cells. The supernatant was decanted and each pellet resuspended in 100 μl TES (0.2M Tris HCl pH8.0, 0.5 mM EDTA, 0.5M sucrose) and transferred to a fresh 96 well plate. This plate was incubated on ice for 30 minutes and then centrifuged for 10 minutes at 3500 rpm at 4° C. to pellet the cell debris. During centrifugation, 15 μl of freshly made protease inhibitors cocktail (Roche, 1 tablet dissolved in 1.5 ml water) was added to each well of a fresh 96 well plate. Supernatants from the centrifuged plate were then transferred to the plate containing the protease inhibitors. The plate was centrifuged at 3500 rpm for 10 minutes at 4° C. and the supernatant was transferred to a further 96-well plate. This step was repeated at least once more or until there was no sign of any cell debris following centrifugation. Finally, the plate was covered in foil to prevent evaporation of samples during the BIAcore run.

Generation of a High Density HIS-B Lymphocyte Stimulator Surface

All BIAcore analysis was performed on BIAcore 2000 machines, using the BIAcore 2000 control software and evaluated using the BIAevaluation 3.0 software. A high density His-tagged B Lymphocyte Stimulator surface (>1000 RU HIS-B Lymphocyte Stimulator coupled) was prepared in flow cell 2 by amine coupling to a CM5 chip. A new CM5 chip was inserted into the BIAcore and a sensorgram started over flow cell 2 with HBS buffer at a flow rate of 5 μl/min. The NHS and EDC solution were mixed 1:1 before injecting 30 μl over the CM5 surface. Fifty μl HIS-B Lymphocyte Stimulator (at 10 μg/ml in Sodium acetate buffer, pH4) was injected and allowed to couple to the surface. Thirty μl of ethanolamine-HCl solution was then injected to block free NHS esters. Prior to using the chip, 10 μl of 4M Guanidine hydrochloride in HBS was injected over the surface to strip the surface of non-covalently bound B Lymphocyte Stimulator. A blank surface (no HIS-B Lymphocyte Stimulator) was also prepared over flow cell 1 so that non-specific binding effects can be subtracted from the HIS-B Lymphocyte Stimulator binding curves.

Typically, a 5000 RU His-tagged B Lymphocyte Stimulator surface was generated in this way and used for 96-well analysis of scFvs isolated from the periplasm of *E. coli.*

BIAcore Analysis

The 96-well plate containing periplasmic scFvs was secured inside the BIAcore. Two ml of 4M Guanidine hydrochloride in HBS was placed in a rack inside the BIAcore for regeneration of the HIS-B Lymphocyte Stimulator surface between samples. The sensorgram was run over flow cells 1 and 2 at a flow rate of 20 μl/minute. The following method was run:

```
MAIN
FLOWCELL 1,2,3,4
LOOP cycle STEP
APROG inj % pos
ENDLOOP
APPEND CONTINUE
END
DEFINE LOOP cycle
LPARAM % pos
r1a1
r1b1
r1c1
r1d1
r1e1
r1f1 etc (all wells listed until r1h12)
END
DEFINE APROG inj
PARAM % pos
FLOW 20
KINJECT % pos 35 30 !scfv injection
```

QUICKINJECT r2f3 10 !regeneration

EXTRACLEAN

END

When the run had finished, the sensorgram data for flow cell 1 was subtracted from the data for flow cell 2 for each sample using the BIAevaluation software. The clones were compared with one another principally by overall RU change as the scFv dissociates from the surface. In addition a few scFvs were identified as having potentially slower off-rates. An example of the dissociation section of a typical sensorgram for 8 scFvs is shown in FIG. 14. An anti-TNFα antibody that does not recognize B Lymphocyte Stimulator was included as a control. Of the 8 scFvs exemplified, I079F06 was identified for further study due to the relatively high numbers of RU's bound to the surface.

ScFvs were identified principally if they demonstrated a RU change of over 1200, a few were also identified as having potentially slower than typical off-rates. A total of 28 clones were chosen on these criteria and are listed in Table 7.

TABLE 7

Identification of 28 antibodies to membrane-bound BLyS that demonstrate the most significant RU changes by BIAcore

| Antibody | Antibody |
|---|---|
| I079C01 | I084C04 |
| I082H08 | I080E05 |
| I079E02 | I083B12 |
| I079B05 | I082G01 |
| I079F06 | I082G02 |
| I079F06 | I082C03 |
| I079F11 | I082A05 |
| I079B12 | I082D07 |
| I080B01 | I082B08 |
| I080G09 | I084A01 |
| I099D03 | I084B02 |
| I080D03 | I080A08 |
| I080A03 | I084C11 |
| I083G03 | |
| I080G07 | |

Example 18 scFv Affinity Determinations

The affinity ($K_D$) of the 28 scFvs was determined using the BIAcore.

Low Density HIS-B Lymphocyte Stimulator Surface for Kinetic Studies

500 RU surfaces were used for kinetic studies of purified scFv binding to HIS-B Lymphocyte Stimulator. The method to prepare these surfaces was identical to the method described in Example 17, only smaller volumes of HIS-B Lymphocyte Stimulator were injected.

Measurement of scFv Binding Kinetics

The chip containing the low density HIS-B Lymphocyte Stimulator surface was inserted into the BIAcore. A dilution series for each of the 28 purified scFvs (prepared as in Example 6) were diluted in HBS (typically starting with 50 μg/ml scFv and double diluting down to 1.5 μg/ml). The dilution series was then injected sequentially over the blank control (flow cell 1) and low density HIS-B Lymphocyte Stimulator surface (flow cell 2) using the following program:

```
MAIN
FLOWCELL 1,2,3,4
APROG            genab      r1d1      ab1
APROG            genab      r1d2      ab2
APROG            genab      r1d3      ab3
APROG            genab      r1d4      ab4
APROG            genab      r1d5      ab5
APROG            genab      r1d6      ab6
APPEND CONTINUE
END
DEFINE APROG genab
PARAM %Abpos %AbId
FLOW             20
KINJECT          %Abpos 200 80
INJECT           r2f3 10
EXTRACLEAN
END
```

Bound scFv were removed by injecting 10 μl of 4M Guanidine hydrochloride in HBS (location r2f3 in the above program) over the surface between samples. Binding curves for individual scFv were analysed using the BIAevaluation software to determine antibody on- and off-rates.

A typical example of the binding curves generated for the scFv antibody I082C03 is shown in FIG. 15. The off-rate for this clone was calculated as $2\times10^{-3}$ $s^{-1}$. The affinity of I082C03 was calculated as 20 nM, assuming 100% activity of the scFv. The 5 scFvs with the highest affinities as scFvs are given in Table 8.

TABLE 8

Identification of 5 antibodies to membrane-bound BLyS that have the highest affinities as scFvs

| Antibody | Affinity ($K_D$) |
|---|---|
| I079F11 | 5 nM |
| I079E02 | 10 nM |
| I082G02 | 6 nM |
| I082H08 | 1 nM |
| I099D03 | 4 nM |

Example 19

Recognition of Mouse Membrane-Bound B Lymphocyte Stimulator

The ability of the 5 scFvs listed in Table 8 to also recognize murine membrane-bound B Lymphocyte Stimulator was determined using a competition ELISA. This assay assesses the ability of test phage scFvs to bind to the membrane-bound form of B Lymphocyte Stimulator on the murine cell line, P388, plasma membranes in the presence of different forms of competing human B Lymphocyte Stimulator. Competing B Lymphocyte Stimulator was either presented as the His-tagged form of B Lymphocyte Stimulator, or soluble B Lymphocyte Stimulator. ScFvs that recognize mouse membrane-bound B Lymphocyte Stimulator would give an ELISA signal on the P388 plasma membranes that is competed out by pre-incubation with HIS-tagged B Lymphocyte Stimulator but not by pre-incubation with soluble B Lymphocyte Stimulator.

Maintenance of P388.D1 Cells and Preparation of Plasma Membranes

P388.D1 cells are a mouse monocyte-macrophage like cell line. They were cultured in L-15 medium supplemented with 2 mM L-glutamine, 10% CS, 10 U penicillin, 100 g/ml streptomycin (all reagents from Sigma). Cells were split 1:4 every 3–4 days to maintain a cell density of 2–8×$10^5$ per ml. A fresh aliquot of cells was thawed from liquid nitrogen every 6 weeks. Plasma membrane fractions were prepared as described in Example 2.

Competition ELISA

P388 plasma membranes (50 μl per well) were coated at 10 μg/ml in PBS onto Falcon 96-well plates overnight at 4° C. The method is otherwise essentially as described Example 16.

The results for 3 clones, I079E02, I082H08 and I099D03 are shown in FIG. 16. All 3 scFvs recognize P388 plasma membranes. This binding is competed out in the presence of HIS-tagged B Lymphocyte Stimulator (HIS-B Lymphocyte Stimulator) but not in the presence of biotinylated B Lymphocyte Stimulator (bio-B Lymphocyte Stimulator). This confirms that these scFvs also recognize the membrane-bound form but not the soluble form of mouse B Lymphocyte Stimulator.

Example 20

Conversion of scFvs to IgG1 Format

The VH domain and the VL domains of scFvs that we wished to convert into IgG molecules were cloned into vectors containing the nucleotide sequences of the appropriate heavy (human IgG1) or light chain (human kappa or human lambda) constant regions such that a complete heavy or light chain molecule could be expressed from these vectors when transfected into an appropriate host cell. Further, when cloned heavy and light chains are both expressed in one cell line (from either one or two vectors), they can assemble into a complete functional antibody molecule that is secreted into the cell culture medium. Methods for converting scFvs into conventional antibody molecules are well known within the art.

Generation of NS0 Cell Lines Expressing Anti-B Lymphocyte Stimulator Antibodies (IgG1)

Plasmids containing the heavy and light chains were separately linearized using the Pvu I restriction enzyme. The linearized DNAs were purified by phenol-chloroform extraction followed by ethanol precipitation and then resuspended in $H_2O$. NS0 cells ($10^7$) from a growing culture were electroporated (0.25 kV and 975 μF) in PBS with 12.5 μg linearized heavy chain plasmid DNA and 37.5 μg linearized light chain DNA. The cells were washed in 20 ml non-selective medium (10% FCS in DMEM supplemented with 6 mM glutamine, amino acids and penicillin/streptomycin) and then transferred in 12.5 ml medium into a T75 $cm^2$ flask and incubated overnight at 37° C., 5% $CO_2$/air. The day after transfection the cells were resuspended in selective medium containing 1 mg/ml geneticin and dispensed into 5×96-well plates at 200 μl/well. After 18 days at 37° C. (5% $CO_2$/air) the colony supernatants were screened by an ELISA that detects assembled human IgG in order to identify colonies expressing IgG. Approximately twenty positive colonies were expanded and adapted to growth in serum-free, selective medium. Duplicate T25 $cm^2$ flasks were set up. Cells from one flask were frozen down as a stock and cells in the second flask were grown to saturation. The productivity of the saturated cultures was assessed by ELISA. The highest producing cell lines were then selected for large-scale antibody production.

The above procedure is exemplified for the I006D08 anti-B Lymphocyte Stimulator antibody constructs. Following electroporation and selection of NS0 cells, supernatants from ninety-three wells each containing a single colony were screened by ELISA to detect assembled IgG1, antibody. Twenty-seven of the supernatants were identified as containing IgG. The colonies from 24 of the positive wells were transferred to 1 ml selective medium in a 24-well plate and allowed to grow for 2 days. The 1 ml cultures of cells were then added to 4 ml selective medium containing reduced serum (0.5% FCS) in a T25 $cm^2$ flask. When the cultures reached confluency 1 ml cells were diluted in 4 ml selective, serum-free medium in a T25 $cm^2$ flask. At confluency this subculture regime was repeated again. Finally 1 ml cells from the culture containing 0.1% FCS was diluted with 9 ml serum-free, selective medium and divided into 2×T25 $cm^2$ to form the saturated and stock cultures. The stock cultures were frozen down and stored in liquid nitrogen once the cultures were confluent. The saturation culture was grown until the viability of the culture was <10%. Twenty-three out of the 24 colonies originally expanded were successfully adapted to growth in serum-free medium. The productivity of these serum-free adapted cell lines ranged from 0.3 to 17 μg/ml by ELISA quantification of the saturated, 5 ml serum-free cultures. The I006D08-32 cell line produced 17 μg/ml.

Large-Scale IgG Production

The highest-producing cell lines were revived from frozen stocks and then expanded to 400 ml in selective, serum-free medium in 2 liter roller bottles. The cells were grown at 37° C. and rolled at 4 rpm with the headspace being re-equilibrated with 5% $CO_2$/air every 2–3 days. Finally the culture was expanded to a 4 liter volume by the addition of serum-free medium without selection (400 ml per 2 liter roller bottle). The cultures were then grown to saturation.

This procedure is exemplified by the production of I006D08 antibody from the I006D08-32 cell line. The frozen stock of I006D08-32 was revived into a T25 $cm^2$ containing 5 ml serum-free medium containing 1 mg/ml geneticin and grown at 37° C. in 5% $CO_2$/air incubator. After two days growth the culture was diluted with 7.5 ml fresh medium and transferred to a T75 $cm^2$ flask. After a further three days in the incubator the cells were transferred to 130 ml selective medium and transferred to a 2 liter roller bottle. After three days growth the cells were diluted with 500 ml selective medium and split into 2×2 liter roller bottles. After another 2 days 100 ml fresh selective medium was added to each roller. Finally the next day the culture was expanded to a total volume of 4 liters with non-selective medium and divided into 10×2 liter roller bottles. After three days the medium was supplemented with 6 mM glutamine. The cells were grown for 17 days from the final subculture into a 4 liter volume. The cells grew up to 3×$10^6$ cells/ml before viability declined to <0.2×$10^6$ cells/ml. At this low viability the culture supernatants were harvested. ELISA analysis indicated that the culture supernatant contained 33 μg/ml IgG. Hence, the 4 liter culture contained 132 mg IgG.

IgG Purification

The purification of the IgG from the fermentation broth is performed using a combination of conventional techniques commonly used for antibody production. Typically the culture harvest is clarified to remove cells and cellular debris prior to starting the purification scheme. This would normally be achieved using either centrifugation or filtration of the harvest. Following clarification, the antibody would typically be captured and significantly purified using affinity chromatography on Protein A Sepharose. The antibody is bound to Protein A Sepharose at basic pH and, following washing of the matrix, is eluted by a reduction of the pH. Further purification of the antibody is then achieved by gel filtration. As well as removing components with different molecular weights from the antibody this step can also be used to buffer exchange into the desired final formulation buffer.

Purification of I006D08 IgG1

The harvest was clarified by sequential filtration through 0.5 μm and 0.22 μm filters. Clarified harvest was then applied to a column of recombinant Protein A Sepharose equilibrated at pH 8.0 and washed with the equilibration buffer. I006D08 antibody was eluted from the Protein A Sepharose by application of a buffer at pH3.5. The collected antibody containing eluate was then neutralized to pH 7.4 by the addition of pH 8.0 buffer. The neutralized eluate was concentrated by ultrafiltration using a 30 KDa cut off membrane. Concentrated material was then purified by Sephacryl S300HR gel filtration using phosphate buffered saline as the mobile phase. The final monomeric IgG1 fraction from the gel filtration column was then concentrated to the desired formulation concentration by ultrafiltration using a 30 KDa cut off membrane. The final product was filtered through a 0.22 μm filter.

Example 21

Antibody Neutralization of Murine Splenocyte Proliferation as Measured by 3HdT Incorporation To determine if an antibody inhibited B Lymphocyte Stimulator mediated B cell proliferation, a splenocyte proliferation assay was performed Briefly, murine splenocytes were isolated by flushing spleen with complete medium using a 25 g needle and 10 ml of complete medium (RPMI 1640 with 10% FBS containing 100 U/ml penicillin, 100 μg/ml streptomycin, 4 mM glutamine, $5\times10^{-5}$M β-mercaptoethanol). The cells were passed through a 100 micron nylon filter to remove cell clumps. The cell suspension was then ficolled at 400×g for 25 minutes at room temperature (one 15 ml conical tube/spleen; 3 ml ficol, 10 ml cell suspension/spleen; Ficol 1083 from Sigma). The recovered cells were washed 3 times in complete medium and counted. Recovered cells were then diluted to a concentration of $3\times10^{6}$/ml in complete medium containing a 3× concentration of SAC (3×=1:33,333 dilution of stock) (*Staph. aureus* Cowan strain; Calbiochem).

For each antibody, 50 microliters of antibody dilutions at 30 μg/ml, 3.0 μg/ml, and 0.3 μg/ml concentrations were aliquotted into individual wells of a 96 well plate in triplicate. Suitable positive controls, such as, for example monoclonal antibody 15C10, were also used. Medium containing no antibody (and human isotype controls (purchased commercially) when necessary) were used as negative controls.

B Lymphocyte Stimulator protein was diluted in complete medium to concentrations of 300 ng/ml, 90 ng/ml and 30 ng/ml. 50 microliters of each of the B Lymphocyte Stimulator dilutions were then added to the antibody dilution series in the plates. The plate containing the antibody and B Lymphocyte Stimulator dilutions are then incubated for 30 minutes at 37° C., 5% $CO_2$, after which 50 microliters of the splenocyte cell suspension containing SAC was added to all wells. The plates were then incubated for 72 hours (37° C., 5% $CO_2$).

After 72 hours, each well was supplemented with 50 μl of complete medium containing 0.5 μCi of 3H-thymidine (6.7 Ci/mM; Amersham) and cells were incubated for an additional 20–24 hours at (37° C., 5% $CO_2$). Following incubation cells were harvested using a Tomtec Cell Harvester and filters counted in a TopCount Scintillation counter (Packard).

Example 22

Human B cell Proliferation Assay for In Vitro Screening of B Lymphocyte Stimulator Antagonist Molecules The bioassay for assessing the effects of putative B Lymphocyte Stimulator antagonists was performed in triplicate in 96 well format by mixing equal volumes of B Lymphocyte Stimulator, responder cells, and putative antagonist each of which is prepared as a 3× stock reagent.

B-lymphocytes were purified from human tonsil by MACS (anti-CD3 depletion), washed, and resuspended in complete medium (CM) (RPMI 1640 with 10% FBS containing 100 U/ml penicillin, 100 μg/ml streptomycin, 4 mM glutamine, 5×10E-5 M beta-mercaptoethanol) at a concentration of 3×10e6 cells/mL. *Staphylococcus aureus*, Cowan I (SAC, CalBiochem) was added to cells at 3× concentration (3×=1:33,333 dilution of stock Meanwhile, eight serial dilutions (3-fold) of potential antagonist were prepared in CM such that the diluted antagonists are at 3× the final concentrations to be tested in the assay. Antibodies are routinely tested starting at a final concentration of 10 ug/mL and going down to about 1.5 ng/mL.

Human rB Lymphocyte Stimulator was prepared in CM to 3× concentration (3×=300 ng/mL, 30 ng/mL, and 3 ng/mL) in CM. Potential inhibitors were routinely tested at several concentrations of B Lymphocyte Stimulator to avoid false negatives due to unexpectedly low affinity or antagonist concentration.

Fifty microliters of diluted antagonist and 50 uL of diluted B Lymphocyte Stimulator were added to the putative antagonist dilution series.

Cells were then incubated for 72 hours (37° C., 5% $CO_2$) in a fully humidified chamber. After 72 hrs., the cells were supplemented with 0.5 μCi/well 3H-thymidine (6.7 Ci/mmol) and incubated for an additional 24 hours. Plates were harvested using a Tomtec Cell Harvester and filters counted in a TopCount Scintillation counter (Packard).

The entire disclosure of each document cited (including patents, patent applications, journal articles, abstracts, laboratory manuals, books, or other disclosures) in this application is incorporated in their entireties herein by reference. Further, the sequences disclosed herein are also disclosed in U.S. Provisional Application 60/212,210 filed Jun. 16, 2000 the contents of which are incorporated in their entireties herein by reference.

TABLE 1 scFvs that Immunospecifically Bind to BLyS

| Clone ID | scFv SEQ ID NO | AAs of VL | AAs of VL CDR1 | AAs of VL CDR2 | AAs of VL CDR3 | AAs of VH | AAs of VH CDR1 | AAs of VH CDR2 | AAs of VH CDR3 | VH CDR3 Sequence (SEQ ID NO) |
|---|---|---|---|---|---|---|---|---|---|---|
| I003F12S | 1 | 138–248 | 160–173 | 22 189–195 | 228–237 | 1–122 | 26–35 | 50–66 | 99–111 | HDDDVLTGYYFES (SEQ ID NO: 2130) |
| I006D08 | 2 | 139–249 | 163–173 | 189–195 | 228–238 | 1–123 | 26–35 | 50–66 | 99–112 | SRDLLLFPHYGMDV (SEQ ID NO: 2133) |
| I008A11 | 3 | 144–254 | 166–179 | 195–201 | 234–243 | 1–128 | 26–37 | 52–69 | 102–117 | DRYDILTGYYYYGMDV (SEQ ID NO: 2129) |
| I017D10 | 4 | 148–255 | 169–179 | 195–201 | 234–244 | 1–132 | 26–35 | 50–66 | 99–121 | VQMDSEYYDLLTGINVGPYYFDY (SEQ ID NO: 2132) |
| I022D01 | 5 | 142–249 | 163–173 | 189–195 | 228–238 | 1–126 | 26–35 | 50–66 | 99–115 | DGYYDILTGYSYYGMDV (SEQ ID NO: 2135) |
| I031F02 | 6 | 137–251 | 160–173 | 189–195 | 228–240 | 1–121 | 26–35 | 50–66 | 99–110 | GYDSSAFRAFDI (SEQ ID NO: 2136) |
| I050A12 | 7 | 140–250 | 164–174 | 190–196 | 229–239 | 1–124 | 26–35 | 50–66 | 99–113 | APYDLLTHYFHYFDY (SEQ ID NO: 2134) |
| I051C04 | 8 | 145–256 | 168–181 | 197–203 | 236–245 | 1–129 | 26–35 | 50–66 | 99–118 | AATTSQKHNKYAYYFYGMDV (SEQ ID NO: 2131) |
| I050B11 | 9 | 141–251 | 166–177 | 193–199 | 232–240 | 1–125 | 26–35 | 50–66 | 99–114 | PFYDTLTSYVFQYFDH (SEQ ID NO: 2137) |
| I050B11-01 | 10 | 141–251 | 166–177 | 193–199 | 232–240 | 1–125 | 26–35 | 50–66 | 99–114 | PFYDTLTSYVFQVWVA (SEQ ID NO: 2143) |
| I050B11-02 | 11 | 141–251 | 166–177 | 193–199 | 232–240 | 1–125 | 26–35 | 50–66 | 99–114 | PFYDTLTSYVFQVWVA (SEQ ID NO: 2143) |
| I050B11-03 | 12 | 141–251 | 166–177 | 193–199 | 232–240 | 1–125 | 26–35 | 50–66 | 99–114 | PFYDTLTRYVFQYFDH (SEQ ID NO: 2144) |
| I050B11-04 | 13 | 141–251 | 166–177 | 193–199 | 232–240 | 1–125 | 26–35 | 50–66 | 99–114 | PFYDTLTGYVFQYFDH (SEQ ID NO: 2141) |
| I050B11-05 | 14 | 141–251 | 166–177 | 193–199 | 232–240 | 1–125 | 26–35 | 50–66 | 99–114 | PFYDTLTRYVFQVWVA (SEQ ID NO: 2142) |
| I050B11-06 | 15 | 141–251 | 166–177 | 193–199 | 232–240 | 1–125 | 26–35 | 50–66 | 99–114 | PFYDTLTGYVFQVWVA (SEQ ID NO: 2140) |
| I050B11-07 | 16 | 141–251 | 166–177 | 193–199 | 232–240 | 1–125 | 26–35 | 50–66 | 99–114 | PFYDTLTRYVFQYFDH (SEQ ID NO: 2144) |
| I050B11-08 | 17 | 141–251 | 166–177 | 193–199 | 232–240 | 1–125 | 26–35 | 50–66 | 99–114 | PFYDTLTGYVFQYFDH (SEQ ID NO: 2141) |
| I050B11-09 | 18 | 141–251 | 166–177 | 193–199 | 232–240 | 1–125 | 26–35 | 50–66 | 99–114 | PFYDTLTRYVFQVWVA (SEQ ID NO: 2142) |
| I050B11-10 | 19 | 141–251 | 166–177 | 193–199 | 232–240 | 1–125 | 26–35 | 50–66 | 99–114 | PFYDTLTRYVFQVWVA (SEQ ID NO: 2142) |
| I050B11-11 | 20 | 141–251 | 166–177 | 193–199 | 232–240 | 1–125 | 26–35 | 50–66 | 99–114 | PFYDTLTGYVFQVWVA (SEQ ID NO: 2140) |
| I050B11-12 | 21 | 141–251 | 166–177 | 193–199 | 232–240 | 1–125 | 26–35 | 50–66 | 99–114 | PFYDTLTGYVFQVWVA (SEQ ID NO: 2140) |
| I050B11-13 | 22 | 141–251 | 166–177 | 193–199 | 232–240 | 1–125 | 26–35 | 50–66 | 99–114 | PFYDTLTSYVFQYFDH (SEQ ID NO: 2137) |
| I050B11-14 | 23 | 141–251 | 166–177 | 193–199 | 232–240 | 1–125 | 26–35 | 50–66 | 99–114 | PFYDTLTSYVFQYFDH (SEQ ID NO: 2137) |
| I050B11-15 | 24 | 141–251 | 166–177 | 193–199 | 232–240 | 1–125 | 26–35 | 50–66 | 99–114 | PFYDTLTSYVFQVWVA (SEQ ID NO: 2143) |
| I050B11-16 | 25 | 141–251 | 166–177 | 193–199 | 232–240 | 1–125 | 26–35 | 50–66 | 99–114 | PFYDTLTSYVFQVWVA (SEQ ID NO: 2143) |
| I050B11-17 | 26 | 141–251 | 166–177 | 193–199 | 232–240 | 1–125 | 26–35 | 50–66 | 99–114 | PFYDTLTRYVFQYFDH (SEQ ID NO: 2144) |
| I050B11-18 | 27 | 141–251 | 166–177 | 193–199 | 232–240 | 1–125 | 26–35 | 50–66 | 99–114 | PFYDTLTRYVFQYFDH (SEQ ID NO: 2144) |
| I050B11-19 | 28 | 141–251 | 166–177 | 193–199 | 232–240 | 1–125 | 26–35 | 50–66 | 99–114 | PFYDILTSYVFQYFDH (SEQ ID NO: 2139) |
| I050B11-20 | 29 | 141–251 | 166–177 | 193–199 | 232–240 | 1–125 | 26–35 | 50–66 | 99–114 | PFYDILTSYVFQYFDH (SEQ ID NO: 2139) |
| I050B11-21 | 30 | 141–251 | 166–177 | 193–199 | 232–240 | 1–125 | 26–35 | 50–66 | 99–114 | PFYDILTRYVFQYFDH (SEQ ID NO: 2138) |
| I050B11-22 | 31 | 141–251 | 166–177 | 193–199 | 232–240 | 1–125 | 26–35 | 50–66 | 99–114 | PFYDILTRYVFQYFDH (SEQ ID NO: 2138) |
| I050B11-23 | 32 | 141–251 | 166–177 | 193–199 | 232–240 | 1–125 | 26–35 | 50–66 | 99–114 | PFYDILTRYVFQYFDH (SEQ ID NO: 2138) |
| I050B11-24 | 33 | 141–251 | 166–177 | 193–199 | 232–240 | 1–125 | 26–35 | 50–66 | 99–114 | PFYDILTSYVFQYFDH (SEQ ID NO: 2139) |
| I050B11-25 | 34 | 141–251 | 166–177 | 193–199 | 232–240 | 1–125 | 26–35 | 50–66 | 99–114 | PFYDTLTRYVFQYFDH (SEQ ID NO: 2144) |
| I050B11-26 | 35 | 141–251 | 166–177 | 193–199 | 232–240 | 1–125 | 26–35 | 50–66 | 99–114 | PFYDILTSYVFQYFDH (SEQ ID NO: 2139) |
| I050B11-27 | 36 | 141–251 | 166–177 | 193–199 | 232–240 | 1–125 | 26–35 | 50–66 | 99–114 | PFYDILTRYVFQYFDH (SEQ ID NO: 2138) |
| I050B11-28 | 37 | 141–251 | 166–177 | 193–199 | 232–240 | 1–125 | 26–35 | 50–66 | 99–114 | PFYDTLTSYVFQYFDH (SEQ ID NO: 2137) |
| I093D03 | 38 | 141–251 | 166–177 | 193–199 | 232–240 | 1–125 | 26–35 | 50–66 | 99–114 | PFYDTLTSYVLGYYLS (SEQ ID NO: 2145) |
| I093D09 | 39 | 141–251 | 166–177 | 193–199 | 232–240 | 1–125 | 26–35 | 50–66 | 99–114 | PFYDTLTSYVFQYFDH (SEQ ID NO: 2137) |
| I093G08 | 40 | 141–251 | 166–177 | 193–199 | 232–240 | 1–125 | 26–35 | 50–66 | 99–114 | PFYDTLTSYVFQVWVA (SEQ ID NO: 2143) |
| I097D11 | 41 | 141–251 | 166–177 | 193–199 | 232–240 | 1–125 | 26–35 | 50–66 | 99–114 | PFYDILTSYVFQYFDH (SEQ ID NO: 2139) |
| I101A04 | 42 | 141–251 | 166–177 | 193–199 | 232–240 | 1–125 | 26–35 | 50–66 | 99–114 | PFYDTLTSYVFQYFDH (SEQ ID NO: 2137) |
| I101B01 | 43 | 141–251 | 166–177 | 193–199 | 232–240 | 1–125 | 26–35 | 50–66 | 99–114 | PFYDTLTSYVFQYFDH (SEQ ID NO: 2137) |
| I102A02 | 44 | 141–251 | 166–177 | 193–199 | 232–240 | 1–125 | 26–35 | 50–66 | 99–114 | PFYDTLTSYVFQYFDH (SEQ ID NO: 2137) |
| I102E01 | 45 | 141–251 | 166–177 | 193–199 | 232–240 | 1–125 | 26–35 | 50–66 | 99–114 | PFYDTLTRYVFQYFDH (SEQ ID NO: 2144) |
| I102G06 | 46 | 141–251 | 166–177 | 193–199 | 232–240 | 1–125 | 26–35 | 50–66 | 99–114 | PFYDTLTGYVFQYFDH (SEQ ID NO: 2141) |

TABLE 1-continued scFvs that Immunospecifically Bind to BLyS

| Clone ID | scFv SEQ ID NO | AAs of VL | AAs of VL CDR1 | AAs of VL CDR2 | AAs of VL CDR3 | AAs of VH | AAs of VH CDR1 | AAs of VH CDR2 | AAs of VH CDR3 | VH CDR3 Sequence (SEQ ID NO) |
|---|---|---|---|---|---|---|---|---|---|---|
| I087A07 | 47 | 141–251 | 166–177 | 193–199 | 232–240 | 1–125 | 26–35 | 50–66 | 99–114 | PFYDTLTSYVLPRVIP (SEQ ID NO: 2227) |
| I087A08 | 48 | 140–250 | 165–176 | 192–198 | 231–239 | 1–124 | 26–35 | 50–66 | 99–113 | PFYDTLTSYVCRPHF (SEQ ID NO: 2238) |
| I087A09 | 49 | 140–250 | 165–176 | 192–198 | 231–239 | 1–124 | 26–35 | 50–66 | 99–113 | PFYDTLTSYVRCPYV (SEQ ID NO: 2272) |
| I087B02 | 50 | 140–250 | 165–176 | 192–198 | 231–239 | 1–124 | 26–35 | 50–66 | 99–113 | PFYDTLTSYVFRPDL (SEQ ID NO: 2281) |
| I087B03 | 51 | 140–250 | 165–176 | 192–198 | 231–239 | 1–124 | 26–35 | 50–66 | 99–113 | PFYDTLTSYVKSMPT (SEQ ID NO: 2305) |
| I087B04 | 52 | 140–250 | 165–176 | 192–198 | 231–239 | 1–124 | 26–35 | 50–66 | 99–113 | PFYDTLTSYVPFLYC (SEQ ID NO: 2292) |
| I087B05 | 53 | 140–250 | 165–176 | 192–198 | 231–239 | 1–124 | 26–35 | 50–66 | 99–113 | PFYDTLTSYVPVPST (SEQ ID NO: 2270) |
| I087B06 | 54 | 140–250 | 165–176 | 192–198 | 231–239 | 1–124 | 26–35 | 50–66 | 99–113 | PFYDTLTSYVGIHGL (SEQ ID NO: 2282) |
| I087B08 | 55 | 141–251 | 166–177 | 193–199 | 232–240 | 1–125 | 26–35 | 50–66 | 99–114 | PFYDTLTSYVPCSPPR (SEQ ID NO: 2261) |
| I087B09 | 56 | 140–250 | 165–176 | 192–198 | 231–239 | 1–124 | 26–35 | 50–66 | 99–113 | PFYDTLTSYVCYPPA (SEQ ID NO: 2240) |
| I087C02 | 57 | 140–250 | 165–176 | 192–198 | 231–239 | 1–124 | 26–35 | 50–66 | 99–113 | PFYDTLTSYVLPLLS (SEQ ID NO: 2224) |
| I087C05 | 58 | 140–250 | 165–176 | 192–198 | 231–239 | 1–124 | 26–35 | 50–66 | 99–113 | PFYDTLTSYVALYRL (SEQ ID NO: 2234) |
| I087C06 | 59 | 140–250 | 165–176 | 192–198 | 231–239 | 1–124 | 26–35 | 50–66 | 99–113 | PFYDTLTSYVRASFS (SEQ ID NO: 2271) |
| I087C07 | 60 | 140–250 | 165–176 | 192–198 | 231–239 | 1–124 | 26–35 | 50–66 | 99–113 | PFYDTLTSYVCTPVP (SEQ ID NO: 2319) |
| I087C08 | 61 | 141–251 | 166–177 | 193–199 | 232–240 | 1–125 | 26–35 | 50–66 | 99–114 | PFYDTLTSYVWPSFFS (SEQ ID NO: 2277) |
| I087D01 | 62 | 140–250 | 165–176 | 192–198 | 231–239 | 1–124 | 26–35 | 50–66 | 99–113 | PFYDTLTSYVTPRGY (SEQ ID NO: 2275) |
| I087D02 | 63 | 140–250 | 165–176 | 192–198 | 231–239 | 1–124 | 26–35 | 50–66 | 99–113 | PFYDTLTSYVSSLLS (SEQ ID NO: 2213) |
| I087D03 | 64 | 141–251 | 166–177 | 193–199 | 232–240 | 1–125 | 26–35 | 50–66 | 99–114 | PFYDTLTSYVPLLPLC (SEQ ID NO: 2263) |
| I087D05 | 65 | 141–251 | 166–177 | 193–199 | 232–240 | 1–125 | 26–35 | 50–66 | 99–114 | PFYDTLTSYVPPPSFL (SEQ ID NO: 2266) |
| I087D07 | 66 | 140–250 | 165–176 | 192–198 | 231–239 | 1–124 | 26–35 | 50–66 | 99–113 | PFYDTLTSYVPTSTT (SEQ ID NO: 2269) |
| I087D09 | 67 | 141–251 | 166–177 | 193–199 | 232–240 | 1–125 | 26–35 | 50–66 | 99–114 | PFYDTLTSYVISCSWA (SEQ ID NO: 2299) |
| I087E04 | 68 | 141–251 | 166–177 | 193–199 | 232–240 | 1–125 | 26–35 | 50–66 | 99–114 | PFYDTLTSYVSALPPP (SEQ ID NO: 2274) |
| I087E05 | 69 | 140–250 | 165–176 | 192–198 | 231–239 | 1–124 | 26–35 | 50–66 | 99–113 | PFYDTLTSYVCRHLF (SEQ ID NO: 2236) |
| I087E10 | 70 | 141–251 | 166–177 | 193–199 | 232–240 | 1–125 | 26–35 | 50–66 | 99–114 | PFYDTLTSYVVSFPSL (SEQ ID NO: 2307) |
| I087F02 | 71 | 141–251 | 166–177 | 193–199 | 232–240 | 1–125 | 26–35 | 50–66 | 99–114 | PFYDTLTSYVMGVTPS (SEQ ID NO: 2322) |
| I087F04 | 72 | 141–251 | 166–177 | 193–199 | 232–240 | 1–125 | 26–35 | 50–66 | 99–114 | PFYDTLTSYVLFRPVL (SEQ ID NO: 2326) |
| I087F05 | 73 | 140–250 | 165–176 | 192–198 | 231–239 | 1–124 | 26–35 | 50–66 | 99–113 | PFYDTLTSYVPSVGG (SEQ ID NO: 2267) |
| I087F07 | 74 | 140–250 | 165–176 | 192–198 | 231–239 | 1–124 | 26–35 | 50–66 | 99–113 | PFYDTLTSYVPPTRH (SEQ ID NO: 2286) |
| I087F08 | 75 | 140–250 | 165–176 | 192–198 | 231–239 | 1–124 | 26–35 | 50–66 | 99–113 | PFYDTLTSYVLRSRD (SEQ ID NO: 2243) |
| I087F09 | 76 | 140–250 | 165–176 | 192–198 | 231–239 | 1–124 | 26–35 | 50–66 | 99–113 | PFYDTLTSYVPLLPP (SEQ ID NO: 2310) |
| I087G05 | 77 | 140–250 | 165–176 | 192–198 | 231–239 | 1–124 | 26–35 | 50–66 | 99–113 | PFYDTLTSYVLRCVL (SEQ ID NO: 2239) |
| I087G06 | 78 | 140–250 | 165–176 | 192–198 | 231–239 | 1–124 | 26–35 | 50–66 | 99–113 | PFYDTLTSYVHPSRS (SEQ ID NO: 2285) |
| I087G07 | 79 | 141–251 | 166–177 | 193–199 | 232–240 | 1–125 | 26–35 | 50–66 | 99–114 | PFYDTLTSYVLRLPPQ (SEQ ID NO: 2241) |
| I087G09 | 80 | 140–250 | 165–176 | 192–198 | 231–239 | 1–124 | 26–35 | 50–66 | 99–113 | PFYDTLTSYVGPYGT (SEQ ID NO: 2284) |
| I087G10 | 81 | 140–250 | 165–176 | 192–198 | 231–239 | 1–124 | 26–35 | 50–66 | 99–113 | PFYDTLTSYVTTPCT (SEQ ID NO: 2276) |
| I087H02 | 82 | 137–244 | 160–170 | 186–192 | 225–233 | 1–121 | 26–35 | 50–66 | 99–110 | ASYLSTSSSLDN (SEQ ID NO: 2265) |
| I088A01 | 83 | 141–251 | 166–177 | 193–199 | 232–240 | 1–125 | 26–35 | 50–66 | 99–114 | PFYDTLTSYVFQYFDH (SEQ ID NO: 2137) |
| I088A03 | 84 | 141–251 | 166–177 | 193–199 | 232–240 | 1–125 | 26–35 | 50–66 | 99–114 | PFYDTLTSYVIPFLPL (SEQ ID NO: 2290) |
| I088A04 | 85 | 141–251 | 166–177 | 193–199 | 232–240 | 1–125 | 26–35 | 50–66 | 99–114 | PFYDTLTSYVLHIYPH (SEQ ID NO: 2335) |
| I088A08 | 86 | 141–251 | 166–177 | 193–199 | 232–240 | 1–125 | 26–35 | 50–66 | 99–114 | PFYDTLTNYVFEYYAS (SEQ ID NO: 2323) |
| I088A09 | 87 | 141–251 | 166–177 | 193–199 | 232–240 | 1–125 | 26–35 | 50–66 | 99–114 | PFYDTLTSYVILYYLH (SEQ ID NO: 2295) |
| I088A10 | 88 | 141–251 | 166–177 | 193–199 | 232–240 | 1–125 | 26–35 | 50–66 | 99–114 | PFYDTLTSYVFQYFDH (SEQ ID NO: 2137) |
| I088A11 | 89 | 141–251 | 166–177 | 193–199 | 232–240 | 1–125 | 26–35 | 50–66 | 99–114 | PFYDTLTSYVLMYFPH (SEQ ID NO: 2220) |
| I088A12 | 90 | 141–251 | 166–177 | 193–199 | 232–240 | 1–125 | 26–35 | 50–66 | 99–114 | PFYDTLTSYVLFFYPL (SEQ ID NO: 2325) |
| I088B01 | 91 | 141–251 | 166–177 | 193–199 | 232–240 | 1–125 | 26–35 | 50–66 | 99–114 | PFYDTLTSYVFQYFDH (SEQ ID NO: 2137) |
| I088B02 | 92 | 141–251 | 166–177 | 193–199 | 232–240 | 1–125 | 26–35 | 50–66 | 99–114 | PFYDTLTSYVFDYYAS (SEQ ID NO: 2244) |
| I088B03 | 93 | 141–251 | 166–177 | 193–199 | 232–240 | 1–125 | 26–35 | 50–66 | 99–114 | PFYDTLTSYVIPFLPL (SEQ ID NO: 2290) |

TABLE 1-continued scFvs that Immunospecifically Bind to BLyS

| Clone ID | scFv SEQ ID NO | AAs of VL | AAs of VL CDR1 | AAs of VL CDR2 | AAs of VL CDR3 | AAs of VH | AAs of VH CDR1 | AAs of VH CDR2 | AAs of VH CDR3 | VH CDR3 Sequence (SEQ ID NO) |
|---|---|---|---|---|---|---|---|---|---|---|
| I088B05 | 94 | 141–251 | 166–177 | 193–199 | 232–240 | 1–125 | 26–35 | 50–66 | 99–114 | PFYDTLTSYVFQYFDH (SEQ ID NO: 2137) |
| I088B06 | 95 | 141–251 | 166–177 | 193–199 | 232–240 | 1–125 | 26–35 | 50–66 | 99–114 | PFYDTLTSYVFEYYSL (SEQ ID NO: 2324) |
| I088B07 | 96 | 141–251 | 166–177 | 193–199 | 232–240 | 1–125 | 26–35 | 50–66 | 99–114 | PFYDTLTSYVFQYFDH (SEQ ID NO: 2137) |
| I088B08 | 97 | 141–251 | 166–177 | 193–199 | 232–240 | 1–125 | 26–35 | 50–66 | 99–114 | PFYDTLTSYVFQYFDH (SEQ ID NO: 2137) |
| I088B09 | 98 | 141–251 | 166–177 | 193–199 | 232–240 | 1–125 | 26–35 | 50–66 | 99–114 | PFYDTLTSYVLEFYLL (SEQ ID NO: 2303) |
| I088B10 | 99 | 141–251 | 166–177 | 193–199 | 232–240 | 1–125 | 26–35 | 50–66 | 99–114 | PFYDTLTSYVFQYFDH (SEQ ID NO: 2137) |
| I088B12 | 100 | 140–250 | 165–176 | 192–198 | 231–239 | 1–124 | 26–35 | 50–66 | 99–113 | PFYDTLTSYVLPLDS (SEQ ID NO: 2223) |
| I088C01 | 101 | 141–251 | 166–177 | 193–199 | 232–240 | 1–125 | 26–35 | 50–66 | 99–114 | PFYDTLTSYVLYFYPS (SEQ ID NO: 2317) |
| I088C03 | 102 | 141–251 | 166–177 | 193–199 | 232–240 | 1–125 | 26–35 | 50–66 | 99–114 | PFYDTLTSYVFQYFDH (SEQ ID NO: 2137) |
| I088C09 | 103 | 141–251 | 166–177 | 193–199 | 232–240 | 1–125 | 26–35 | 50–66 | 99–114 | PFYDTLTSYVFQYFDH (SEQ ID NO: 2137) |
| I088C12 | 104 | 141–251 | 166–177 | 193–199 | 232–240 | 1–125 | 26–35 | 50–66 | 99–114 | PFYDTLTSYVFQYFDH (SEQ ID NO: 2137) |
| I088D01 | 105 | 141–251 | 166–177 | 193–199 | 232–240 | 1–125 | 26–35 | 50–66 | 99–114 | PFYDTLTSYVFQYFDH (SEQ ID NO: 2137) |
| I088D03 | 106 | 141–251 | 166–177 | 193–199 | 232–240 | 1–125 | 26–35 | 50–66 | 99–114 | PFYDTLTSYVLHYYAL (SEQ ID NO: 2215) |
| I088D04 | 107 | 140–250 | 165–176 | 192–198 | 231–239 | 1–124 | 26–35 | 50–66 | 99–113 | PFYDTLTSYVLPPSV (SEQ ID NO: 2225) |
| I088D07 | 108 | 141–251 | 166–177 | 193–199 | 232–240 | 1–125 | 26–35 | 50–66 | 99–114 | PFYDTLTSYVFQYFDH (SEQ ID NO: 2137) |
| I088D08 | 109 | 141–251 | 166–177 | 193–199 | 232–240 | 1–125 | 26–35 | 50–66 | 99–114 | PFYDTLTSYVFQYFDH (SEQ ID NO: 2137) |
| I088D11 | 110 | 141–251 | 166–177 | 193–199 | 232–240 | 1–125 | 26–35 | 50–66 | 99–114 | PFYDTLTSYVFQYFDH (SEQ ID NO: 2137) |
| I088E01 | 111 | 138–248 | 163–174 | 190–196 | 229–237 | 1–122 | 23–32 | 47–63 | 96–111 | PFYDTLTSYVFQYFDH (SEQ ID NO: 2137) |
| I088E02 | 112 | 141–251 | 166–177 | 193–199 | 232–240 | 1–125 | 26–35 | 50–66 | 99–114 | PFYDTLTSYVLHYYLY (SEQ ID NO: 2216) |
| I088E03 | 113 | 141–251 | 166–177 | 193–199 | 232–249 | 1–125 | 26–35 | 50–66 | 99–114 | PFYDTLTSYVFQYFDH (SEQ ID NO: 2137) |
| I088E04 | 114 | 141–251 | 166–177 | 193–199 | 232–240 | 1–125 | 26–35 | 50–66 | 99–114 | PFYDTLTSYVFQYFDH (SEQ ID NO: 2137) |
| I088E08 | 115 | 141–251 | 166–177 | 193–199 | 232–240 | 1–125 | 26–35 | 50–66 | 99–114 | PFYDTLTSYVFQYFDH (SEQ ID NO: 2137) |
| I088E10 | 116 | 141–251 | 166–177 | 193–199 | 232–240 | 1–125 | 26–35 | 50–66 | 99–114 | PFYDTLTSYVFQYFDH (SEQ ID NO: 2137) |
| I088E11 | 117 | 141–251 | 166–177 | 193–199 | 232–240 | 1–125 | 26–35 | 50–66 | 99–114 | PFYDTLTSYVFQYFDH (SEQ ID NO: 2137) |
| I088F07 | 118 | 141–251 | 166–177 | 193–199 | 232–240 | 1–125 | 26–35 | 50–66 | 99–114 | PFYDTLTSYVFQYFDH (SEQ ID NO: 2137) |
| I088G02 | 119 | 141–251 | 166–177 | 193–199 | 232–240 | 1–125 | 26–35 | 50–66 | 99–114 | PFYDTLTSYVFQYFDH (SEQ ID NO: 2137) |
| I088G03 | 120 | 141–251 | 166–177 | 193–199 | 232–240 | 1–125 | 26–35 | 50–66 | 99–114 | PFYDTLTSYVFQYFDH (SEQ ID NO: 2137) |
| I088G07 | 121 | 141–251 | 166–177 | 193–199 | 232–240 | 1–125 | 26–35 | 50–66 | 99–114 | PFYDTLTSYVFHYYPL (SEQ ID NO: 2260) |
| I088G09 | 122 | 141–251 | 166–177 | 193–199 | 232–240 | 1–125 | 26–35 | 50–66 | 99–114 | PFYDTLTSYVFPVYYL (SEQ ID NO: 2264) |
| I088G10 | 123 | 141–251 | 166–177 | 193–199 | 232–240 | 1–125 | 26–35 | 50–66 | 99–114 | PFYDTLTSYVLHFIDH (SEQ ID NO: 2301) |
| I088H05 | 124 | 141–251 | 166–177 | 193–199 | 232–240 | 1–125 | 26–35 | 50–66 | 99–114 | PFYDTLTSYVFQYFDH (SEQ ID NO: 2137) |
| I088H07 | 125 | 141–251 | 166–177 | 193–199 | 232–240 | 1–125 | 26–35 | 50–66 | 99–114 | PFYDTLTSYVFQYFDH (SEQ ID NO: 2137) |
| I092A03 | 126 | 141–251 | 166–177 | 193–199 | 232–240 | 1–125 | 26–35 | 50–66 | 99–114 | PFYDTLTSYVFQYFDH (SEQ ID NO: 2137) |
| I092A05 | 127 | 141–251 | 166–177 | 193–199 | 232–240 | 1–125 | 26–35 | 50–66 | 99–114 | PFYDTLTSYVFHYYDV (SEQ ID NO: 2258) |
| I092A06 | 128 | 141–251 | 166–177 | 193–199 | 232–240 | 1–125 | 26–35 | 50–66 | 99–114 | PFYDTLTSYVFQYFDH (SEQ ID NO: 2137) |
| I092A08 | 129 | 141–251 | 166–177 | 193–199 | 232–240 | 1–125 | 26–35 | 50–66 | 99–114 | PFYDTLTSYVHEFFSL (SEQ ID NO: 2283) |
| I092A10 | 130 | 141–251 | 166–177 | 193–199 | 232–240 | 1–125 | 26–35 | 50–66 | 99–114 | PFYDTLTSYVFQYFDH (SEQ ID NO: 2137) |
| I092A11 | 131 | 141–251 | 166–177 | 193–199 | 232–240 | 1–125 | 26–35 | 50–66 | 99–114 | PFYDTLTSYVFQYFDH (SEQ ID NO: 2137) |
| I092B01 | 132 | 141–251 | 166–177 | 193–199 | 232–240 | 1–125 | 26–35 | 50–66 | 99–114 | PFYDTLTSYVFQYFDH (SEQ ID NO: 2137) |
| I092B02 | 133 | 141–251 | 166–177 | 193–199 | 232–240 | 1–125 | 26–35 | 50–66 | 99–114 | PFYDTLTSYVFQYFDH (SEQ ID NO: 2137) |
| I092B04 | 134 | 141–251 | 166–177 | 193–199 | 232–240 | 1–125 | 26–35 | 50–66 | 99–114 | PFYDTLTSYVFQYFDH (SEQ ID NO: 2137) |
| I092B05 | 135 | 141–251 | 166–177 | 193–199 | 232–240 | 1–125 | 26–35 | 50–66 | 99–114 | PFYDTLTSYVFQYFDH (SEQ ID NO: 2137) |
| I092B10 | 136 | 141–251 | 166–177 | 193–199 | 232–240 | 1–125 | 26–35 | 50–66 | 99–114 | PFYDTLTSYVFQYFDH (SEQ ID NO: 2137) |
| I092B12 | 137 | 141–251 | 166–177 | 193–199 | 232–240 | 1–125 | 26–35 | 50–66 | 99–114 | PFYDTLTSYVFQYFDH (SEQ ID NO: 2137) |
| I092C01 | 138 | 141–251 | 166–177 | 193–199 | 232–240 | 1–125 | 26–35 | 50–66 | 99–114 | PFYDTLTSYVFQYFDH (SEQ ID NO: 2137) |
| I092C02 | 139 | 141–251 | 166–177 | 193–199 | 232–240 | 1–125 | 26–35 | 50–66 | 99–114 | PFYDTLTSYVFQYFDH (SEQ ID NO: 2137) |
| I092C07 | 140 | 140–250 | 165–176 | 192–198 | 231–239 | 1–124 | 26–35 | 50–66 | 99–113 | PFYDTLTSYVLALDL (SEQ ID NO: 2328) |

TABLE 1-continued scFvs that Immunospecifically Bind to BLyS

| Clone ID | scFv SEQ ID NO | AAs of VL | AAs of VL CDR1 | AAs of VL CDR2 | AAs of VL CDR3 | AAs of VH | AAs of VH CDR1 | AAs of VH CDR2 | AAs of VH CDR3 | VH CDR3 Sequence (SEQ ID NO) |
|---|---|---|---|---|---|---|---|---|---|---|
| I092C08 | 141 | 141–251 | 166–177 | 193–199 | 232–240 | 1–125 | 26–35 | 50–66 | 99–114 | PFYDTLTSYVFGYYSL (SEQ ID NO: 2254) |
| I092C12 | 142 | 141–251 | 166–177 | 193–199 | 232–240 | 1–125 | 26–35 | 50–66 | 99–114 | PFYDTLTSYVFQYFDH (SEQ ID NO: 2137) |
| I092D01 | 143 | 141–251 | 166–177 | 193–199 | 232–240 | 1–125 | 26–35 | 50–66 | 99–114 | PFYDTLTSYVLKYYTD (SEQ ID NO: 2226) |
| I092D07 | 144 | 141–251 | 166–177 | 193–199 | 232–240 | 1–125 | 26–35 | 50–66 | 99–114 | PFYDTLTSYVFQYFDH (SEQ ID NO: 2137) |
| I092D09 | 145 | 141–251 | 166–177 | 193–199 | 232–240 | 1–125 | 26–35 | 50–66 | 99–114 | PFYDTLTSYVMHAYPL (SEQ ID NO: 2255) |
| I092D10 | 146 | 141–251 | 166–177 | 193–199 | 232–240 | 1–125 | 26–35 | 50–66 | 99–114 | PFYDTLTSYVFHYLPV (SEQ ID NO: 2256) |
| I092D11 | 147 | 141–251 | 166–177 | 193–199 | 232–240 | 1–125 | 26–35 | 50–66 | 99–114 | PFYDTLTSYVFQYFDH (SEQ ID NO: 2137) |
| I092E01 | 148 | 141–251 | 166–177 | 193–199 | 232–240 | 1–125 | 26–35 | 50–66 | 99–114 | PFYDTLTSYVFQYFDH (SEQ ID NO: 2137) |
| I092E03 | 149 | 141–251 | 166–177 | 193–199 | 232–240 | 1–125 | 26–35 | 50–66 | 99–114 | PFYDTLTSYAFQYFDH (SEQ ID NO: 2230) |
| I092E04 | 150 | 141–251 | 166–177 | 193–199 | 232–240 | 1–125 | 26–35 | 50–66 | 99–114 | PFYDTLTSYVFEYFSV (SEQ ID NO: 2248) |
| I092E07 | 151 | 141–251 | 166–177 | 193–199 | 232–240 | 1–125 | 26–35 | 50–66 | 99–114 | PFYDTLTSYVFQYFDH (SEQ ID NO: 2137) |
| I092E10 | 152 | 141–251 | 166–177 | 193–199 | 232–240 | 1–125 | 26–35 | 50–66 | 99–114 | PFYDTLTSYVLFYYPL (SEQ ID NO: 2327) |
| I092E11 | 153 | 141–251 | 166–177 | 193–199 | 232–240 | 1–125 | 26–35 | 50–66 | 99–114 | PFYDTLTSYVFQYFDH (SEQ ID NO: 2137) |
| I092F01 | 154 | 141–251 | 166–177 | 193–199 | 232–240 | 1–125 | 26–35 | 50–66 | 99–114 | PFYDTLTSYVFQYFDH (SEQ ID NO: 2137) |
| I092F02 | 155 | 141–251 | 166–177 | 193–199 | 232–240 | 1–125 | 26–35 | 50–66 | 99–114 | PFYDTLTSYVFQYFDH (SEQ ID NO: 2137) |
| I092F05 | 156 | 141–251 | 166–177 | 193–199 | 232–240 | 1–125 | 26–35 | 50–66 | 99–114 | PFYDTLTSYVFQYFDH (SEQ ID NO: 2137) |
| I092F07 | 157 | 141–251 | 166–177 | 193–199 | 232–240 | 1–125 | 26–35 | 50–66 | 99–114 | PFYDTLTSYVFQYFDH (SEQ ID NO: 2137) |
| I092F08 | 158 | 141–251 | 166–177 | 193–199 | 232–240 | 1–125 | 26–35 | 50–66 | 99–114 | PFYDTLTSYVFQYFDH (SEQ ID NO: 2137) |
| I092F11 | 159 | 141–251 | 166–177 | 193–199 | 232–240 | 1–125 | 26–35 | 50–66 | 99–114 | PFYDTLTSYVFQYFDH (SEQ ID NO: 2137) |
| I092F12 | 160 | 141–251 | 166–177 | 193–199 | 232–240 | 1–125 | 26–35 | 50–66 | 99–114 | PFYDTLTSYVLAYYPD (SEQ ID NO: 2306) |
| I092G01 | 161 | 141–251 | 166–177 | 193–199 | 232–240 | 1–125 | 26–35 | 50–66 | 99–114 | PFYDTLTSYVFQYFDH (SEQ ID NO: 2137) |
| I092G05 | 162 | 141–251 | 166–177 | 193–199 | 232–240 | 1–125 | 26–35 | 50–66 | 99–114 | PFYDTLTSYVFQYFDH (SEQ ID NO: 2137) |
| I092G10 | 163 | 141–251 | 166–177 | 193–199 | 232–240 | 1–125 | 26–35 | 50–66 | 99–114 | PFYDTLTSYVFQYFDH (SEQ ID NO: 2137) |
| I092H01 | 164 | 137–244 | 160–170 | 186–192 | 225–233 | 1–121 | 26–35 | 50–66 | 99–110 | ASYLSTSSSLDN (SEQ ID NO: 2265) |
| I093A06 | 165 | 141–251 | 166–177 | 193–199 | 232–240 | 1–125 | 26–35 | 50–66 | 99–114 | PFYDTLTSYVLPVYDH (SEQ ID NO: 2334) |
| I093A09 | 166 | 141–251 | 166–177 | 193–199 | 232–240 | 1–125 | 26–35 | 50–66 | 99–114 | PFYDTLTSYVFQYFAH (SEQ ID NO: 2268) |
| I093A11 | 167 | 141–251 | 166–177 | 193–199 | 232–240 | 1–125 | 26–35 | 50–66 | 99–114 | PFYDTLTSYVFQYFDH (SEQ ID NO: 2137) |
| I093A12 | 168 | 141–251 | 166–177 | 193–199 | 232–240 | 1–125 | 26–35 | 50–66 | 99–114 | PFYDTLTSYVFQYFDH (SEQ ID NO: 2137) |
| I093B02 | 169 | 141–251 | 166–177 | 193–199 | 232–240 | 1–125 | 26–35 | 50–66 | 99–114 | PFYDTLTSYVFQYFDH (SEQ ID NO: 2137) |
| I093B05 | 170 | 141–251 | 166–177 | 193–199 | 232–240 | 1–125 | 26–35 | 50–66 | 99–114 | PFYDTLTSYVIFYYPT (SEQ ID NO: 2289) |
| I093B06 | 171 | 141–251 | 166–177 | 193–199 | 232–240 | 1–125 | 26–35 | 50–66 | 99–114 | PFYDTLTSYVFQYFDH (SEQ ID NO: 2137) |
| I093B09 | 172 | 141–251 | 166–177 | 193–199 | 232–240 | 1–125 | 26–35 | 50–66 | 99–114 | PFYDTLTSYVLEVYHP (SEQ ID NO: 2318) |
| I093B12 | 173 | 141–251 | 166–177 | 193–199 | 232–240 | 1–125 | 26–35 | 50–66 | 99–114 | PFYDTLTSYVFAPLVT (SEQ ID NO: 2242) |
| I093C02 | 174 | 141–251 | 166–177 | 193–199 | 232–240 | 1–125 | 26–35 | 50–66 | 99–114 | PFYDTLTSYVLHAYAF (SEQ ID NO: 2332) |
| I093C03 | 175 | 141–251 | 166–177 | 193–199 | 232–240 | 1–125 | 26–35 | 50–66 | 99–114 | PFYDTLTSYVFQYFDH (SEQ ID NO: 2137) |
| I093C05 | 176 | 141–251 | 166–177 | 193–199 | 232–240 | 1–125 | 26–35 | 50–66 | 99–114 | PFYDTLTSYVILYYLH (SEQ ID NO: 2295) |
| I093D05 | 177 | 141–251 | 166–177 | 193–199 | 232–240 | 1–125 | 26–35 | 50–66 | 99–114 | PFYDTLTSYVFEFLPL (SEQ ID NO: 2245) |
| I093D08 | 178 | 141–251 | 166–177 | 193–199 | 232–240 | 1–125 | 26–35 | 50–66 | 99–114 | PFYDTLTSYVRPFYAH (SEQ ID NO: 2273) |
| I093D10 | 179 | 141–251 | 166–177 | 193–199 | 232–240 | 1–125 | 26–35 | 50–66 | 99–114 | PFYDTLTSYVFQYFDH (SEQ ID NO: 2137) |
| I093D12 | 180 | 141–251 | 166–177 | 193–199 | 232–240 | 1–125 | 26–35 | 50–66 | 99–114 | PFYDTLTSYVLHFYRV (SEQ ID NO: 2302) |
| I093E01 | 181 | 141–251 | 166–177 | 193–199 | 232–240 | 1–125 | 26–35 | 50–66 | 99–114 | PFYDTLTSYVFQYFDH (SEQ ID NO: 2137) |
| I093E02 | 182 | 141–251 | 166–177 | 193–199 | 232–240 | 1–125 | 26–35 | 50–66 | 99–114 | PFYDTLTSYVIQYFDH (SEQ ID NO: 2297) |
| I093E05 | 183 | 141–251 | 166–177 | 193–199 | 232–240 | 1–125 | 26–35 | 50–66 | 99–114 | PFYDTLTSYVHEFFSL (SEQ ID NO: 2283) |
| I093E08 | 184 | 141–251 | 166–177 | 193–199 | 232–240 | 1–125 | 26–35 | 50–66 | 99–114 | PFYDTLTSYVMQFFPT (SEQ ID NO: 2321) |
| I093E10 | 185 | 141–251 | 166–177 | 193–199 | 232–240 | 1–125 | 26–35 | 50–66 | 99–114 | PFYDTLTSYVLSFYPV (SEQ ID NO: 2246) |
| I093F01 | 186 | 141–251 | 166–177 | 193–199 | 232–240 | 1–125 | 26–35 | 50–66 | 99–114 | PFYDTLTSYVLYYYAF (SEQ ID NO: 2251) |
| I093F03 | 187 | 141–251 | 166–177 | 193–199 | 232–240 | 1–125 | 26–35 | 50–66 | 99–114 | PFYDTLTSYVFQYFDH (SEQ ID NO: 2137) |

TABLE 1-continued scFvs that Immunospecifically Bind to BLyS

| Clone ID | scFv SEQ ID NO | AAs of VL | AAs of VL CDR1 | AAs of VL CDR2 | AAs of VL CDR3 | AAs of VH | AAs of VH CDR1 | AAs of VH CDR2 | AAs of VH CDR3 | VH CDR3 Sequence (SEQ ID NO) |
|---|---|---|---|---|---|---|---|---|---|---|
| I093F05 | 188 | 141–251 | 166–177 | 193–199 | 232–240 | 1–125 | 26–35 | 50–66 | 99–114 | PFYDTLTSYVFQYFDH (SEQ ID NO: 2137) |
| I093F08 | 189 | 141–251 | 166–177 | 193–199 | 232–240 | 1–125 | 26–35 | 50–66 | 99–114 | PFYDTLTSYVFQYFDH (SEQ ID NO: 2137) |
| I093F11 | 190 | 141–251 | 166–177 | 193–199 | 232–240 | 1–125 | 26–35 | 50–66 | 99–114 | PFYDTLTSYVLHFYPL (SEQ ID NO: 2333) |
| I093G07 | 191 | 141–251 | 166–177 | 193–199 | 232–240 | 1–125 | 26–35 | 50–66 | 99–114 | PFYDTLTSYVLQYYVL (SEQ ID NO: 2237) |
| I093G11 | 192 | 141–251 | 166–177 | 193–199 | 232–240 | 1–125 | 26–35 | 50–66 | 99–114 | PFYDTLTSYVFQYFDH (SEQ ID NO: 2137) |
| I093G12 | 193 | 141–251 | 166–177 | 193–199 | 232–240 | 1–125 | 26–35 | 50–66 | 99–114 | PFYDTLTSYVFQYFDH (SEQ ID NO: 2137) |
| I093H06 | 194 | 141–251 | 166–177 | 193–199 | 232–240 | 1–125 | 26–35 | 50–66 | 99–114 | PFYDTLTSYVFQYFDH (SEQ ID NO: 2137) |
| I094A08 | 195 | 141–251 | 166–177 | 193–199 | 232–240 | 1–125 | 26–35 | 50–66 | 99–114 | PFYDTLTSYVFQYFDY (SEQ ID NO: 2280) |
| I094B07 | 196 | 141–251 | 166–177 | 193–199 | 232–240 | 1–125 | 26–35 | 50–66 | 99–114 | PFYDTLTSYVLPVWVS (SEQ ID NO: 2228) |
| I094B08 | 197 | 141–251 | 166–177 | 193–199 | 232–240 | 1–125 | 26–35 | 50–66 | 99–114 | PFYDTLTSYVFQYFDH (SEQ ID NO: 2137) |
| I094B12 | 198 | 141–251 | 166–177 | 193–199 | 232–240 | 1–125 | 26–35 | 50–66 | 99–114 | PFYDTLTSYVFQYFDH (SEQ ID NO: 2137) |
| I094C11 | 199 | 141–251 | 166–177 | 193–199 | 232–240 | 1–125 | 26–35 | 50–66 | 99–114 | PFYDTLTSYVFQYFDH (SEQ ID NO: 2137) |
| I094C12 | 200 | 141–251 | 166–177 | 193–199 | 232–240 | 1–125 | 26–35 | 50–66 | 99–114 | PFYDTLTSYVFQYFDH (SEQ ID NO: 2137) |
| I094D06 | 201 | 141–251 | 166–177 | 193–199 | 232–240 | 1–125 | 26–35 | 50–66 | 99–114 | PFYDTLTSYVIEYYPV (SEQ ID NO: 2288) |
| I094D07 | 202 | 141–251 | 166–177 | 193–199 | 232–240 | 1–125 | 26–35 | 50–66 | 99–114 | PFYDTLTSYVFQYFDH (SEQ ID NO: 2137) |
| I094D08 | 203 | 141–251 | 166–177 | 193–199 | 232–240 | 1–125 | 26–35 | 50–66 | 99–114 | PFYDTLTSYVLHYLPL (SEQ ID NO: 2314) |
| I094D09 | 204 | 141–251 | 166–177 | 193–199 | 232–240 | 1–125 | 26–35 | 50–66 | 99–114 | PFYDTLTSYVFQYFDH (SEQ ID NO: 2137) |
| I094D10 | 205 | 141–251 | 166–177 | 193–199 | 232–240 | 1–125 | 26–35 | 50–66 | 99–114 | PFYDTLTSYVFQYFDH (SEQ ID NO: 2137) |
| I094D11 | 206 | 141–251 | 166–177 | 193–199 | 232–240 | 1–125 | 26–35 | 50–66 | 99–114 | PFYDTLTSYVFHFYPV (SEQ ID NO: 2218) |
| I094E04 | 207 | 141–251 | 166–177 | 193–199 | 232–240 | 1–125 | 26–35 | 50–66 | 99–114 | PFYDTLTSYVFQYFDH (SEQ ID NO: 2137) |
| I094E08 | 208 | 141–251 | 166–177 | 193–199 | 232–240 | 1–125 | 26–35 | 50–66 | 99–114 | PFYDTLTSYVLEAFSL (SEQ ID NO: 2311) |
| I094F04 | 209 | 141–251 | 166–177 | 193–199 | 232–240 | 1–125 | 26–35 | 50–66 | 99–114 | PFYDTLTSYVFGFYPF (SEQ ID NO: 2252) |
| I094F05 | 210 | 141–251 | 166–177 | 193–199 | 232–240 | 1–125 | 26–35 | 50–66 | 99–114 | PFYDTLTSYVFQYFDH (SEQ ID NO: 2137) |
| I094F10 | 211 | 141–251 | 166–177 | 193–199 | 232–240 | 1–125 | 26–35 | 50–66 | 99–114 | PIYDTLTSYVFQYFDH (SEQ ID NO: 2278) |
| I094F11 | 212 | 141–251 | 166–177 | 193–199 | 232–240 | 1–125 | 26–35 | 50–66 | 99–114 | PFYDTLTSYVLWYYQD (SEQ ID NO: 2249) |
| I094F12 | 213 | 141–251 | 166–177 | 193–199 | 232–240 | 1–125 | 26–35 | 50–66 | 99–114 | PFYDTLTSYVIPFYPL (SEQ ID NO: 2296) |
| I094G06 | 214 | 141–251 | 166–177 | 193–199 | 232–240 | 1–125 | 26–35 | 50–66 | 99–114 | PFYDTLTSYVFQYFDH (SEQ ID NO: 2137) |
| I094G10 | 215 | 141–251 | 166–177 | 193–199 | 232–240 | 1–125 | 26–35 | 50–66 | 99–114 | PFYDTLTSYVFQYFDH (SEQ ID NO: 2137) |
| I095A04 | 216 | 141–251 | 166–177 | 193–199 | 232–240 | 1–125 | 26–35 | 50–66 | 99–114 | PFYDTLTSYVFQYFDH (SEQ ID NO: 2137) |
| I095A12 | 217 | 141–251 | 166–177 | 193–199 | 232–240 | 1–125 | 26–35 | 50–66 | 99–114 | PFYDTLTSYVLEYFPL (SEQ ID NO: 2320) |
| I095B04 | 218 | 141–251 | 166–177 | 193–199 | 232–240 | 1–125 | 26–35 | 50–66 | 99–114 | PFYDTLTSYVLEFFPA (SEQ ID NO: 2312) |
| I095B09 | 219 | 141–251 | 166–177 | 193–199 | 232–240 | 1–125 | 26–35 | 50–66 | 99–114 | PFYDTLTSYVIEYLPL (SEQ ID NO: 2287) |
| I095B10 | 220 | 141–251 | 166–177 | 193–199 | 232–240 | 1–125 | 26–35 | 50–66 | 99–114 | PFYDTLTSYVLHYYSA (SEQ ID NO: 2217) |
| I095C02 | 221 | 141–251 | 166–177 | 193–199 | 232–240 | 1–125 | 26–35 | 50–66 | 99–114 | PFYDTLTSYVLFYYTA (SEQ ID NO: 2331) |
| I095C05 | 222 | 141–251 | 166–177 | 193–199 | 232–240 | 1–125 | 26–35 | 50–66 | 99–114 | PFYDTLTSYVLHYLPV (SEQ ID NO: 2337) |
| I095C07 | 223 | 141–251 | 166–177 | 193–199 | 232–240 | 1–125 | 26–35 | 50–66 | 99–114 | PFYDTLTSYVFQYFDH (SEQ ID NO: 2137) |
| I095C08 | 224 | 141–251 | 166–177 | 193–199 | 232–240 | 1–125 | 26–35 | 50–66 | 99–114 | PFYDTLTSYVFQYFDH (SEQ ID NO: 2137) |
| I095C09 | 225 | 141–251 | 166–177 | 193–199 | 232–240 | 1–125 | 26–35 | 50–66 | 99–114 | PFYDTLTSYVMHYYPT (SEQ ID NO: 2259) |
| I095D01 | 226 | 141–251 | 166–177 | 193–199 | 232–240 | 1–125 | 26–35 | 50–66 | 99–114 | PFYDTLTSYVFQYFDH (SEQ ID NO: 2137) |
| I095D02 | 227 | 141–251 | 166–177 | 193–199 | 232–240 | 1–125 | 26–35 | 50–66 | 99–114 | PFYDTLTSYVLQYFRY (SEQ ID NO: 2235) |
| I095D03 | 228 | 141–251 | 166–177 | 193–199 | 232–240 | 1–125 | 26–35 | 50–66 | 99–114 | PFYDTLTSYVLQVFDT (SEQ ID NO: 2233) |
| I095D05 | 229 | 141–251 | 166–177 | 193–199 | 232–240 | 1–125 | 26–35 | 50–66 | 99–114 | PFYDTLTSYVFQYFDH (SEQ ID NO: 2137) |
| I095D09 | 230 | 141–251 | 166–177 | 193–199 | 232–240 | 1–125 | 26–35 | 50–66 | 99–114 | PFYDTLTSYVFQYFDH (SEQ ID NO: 2137) |
| I095E01 | 231 | 141–251 | 166–177 | 193–199 | 232–240 | 1–125 | 26–35 | 50–66 | 99–114 | PFYDTLTSYVLDYYSS (SEQ ID NO: 2309) |
| I095E05 | 232 | 141–251 | 166–177 | 193–199 | 232–240 | 1–125 | 26–35 | 50–66 | 99–114 | PFYDALTSYVFQYFDH (SEQ ID NO: 2221) |
| I095E12 | 233 | 141–251 | 166–177 | 193–199 | 232–240 | 1–125 | 26–35 | 50–66 | 99–114 | PFYDTLTSYVFQYFDH (SEQ ID NO: 2137) |
| I095F06 | 234 | 141–251 | 166–177 | 193–199 | 232–240 | 1–125 | 26–35 | 50–66 | 99–114 | PFYDTLTSYVFPFYPH (SEQ ID NO: 2262) |

TABLE 1-continued scFvs that Immunospecifically Bind to BLyS

| Clone ID | scFv SEQ ID NO | AAs of VL | AAs of VL CDR1 | AAs of VL CDR2 | AAs of VL CDR3 | AAs of VH | AAs of VH CDR1 | AAs of VH CDR2 | AAs of VH CDR3 | VH CDR3 Sequence (SEQ ID NO) |
|---|---|---|---|---|---|---|---|---|---|---|
| I095F09 | 235 | 141–251 | 166–177 | 193–199 | 232–240 | 1–125 | 26–35 | 50–66 | 99–114 | PFYDTLTSYVIGFYPV (SEQ ID NO: 2291) |
| I095G06 | 236 | 141–251 | 166–177 | 193–199 | 232–240 | 1–125 | 26–35 | 50–66 | 99–114 | PFYDTLTSYVFQYFDH (SEQ ID NO: 2137) |
| I095G09 | 237 | 141–251 | 166–177 | 193–199 | 232–240 | 1–125 | 26–35 | 50–66 | 99–114 | PFYDTLTSYVMDFYSV (SEQ ID NO: 2253) |
| I095G11 | 238 | 141–251 | 166–177 | 193–199 | 232–240 | 1–125 | 26–35 | 50–66 | 99–114 | PFYDTLTSYVFQYFDH (SEQ ID NO: 2137) |
| I096A01 | 239 | 141–251 | 166–177 | 193–199 | 232–240 | 1–125 | 26–35 | 50–66 | 99–114 | PFYDTLTSYVFQYFDH (SEQ ID NO: 2137) |
| I096A10 | 240 | 141–251 | 166–177 | 193–199 | 232–240 | 1–125 | 26–35 | 50–66 | 99–114 | PFYDTLTSYVLPFYAL (SEQ ID NO: 2222) |
| I096B01 | 241 | 141–251 | 166–177 | 193–199 | 232–240 | 1–125 | 26–35 | 50–66 | 99–114 | PFYDTLTSYVFQYFDH (SEQ ID NO: 2137) |
| I096B03 | 242 | 141–251 | 166–177 | 193–199 | 232–240 | 1–125 | 26–35 | 50–66 | 99–114 | PFYDTLTSYVFQYFDH (SEQ ID NO: 2137) |
| I096C01 | 243 | 141–251 | 166–177 | 193–199 | 232–240 | 1–125 | 26–35 | 50–66 | 99–114 | PFYDTLTSYVFQYFDH (SEQ ID NO: 2137) |
| I096C06 | 244 | 141–251 | 166–177 | 193–199 | 232–240 | 1–125 | 26–35 | 50–66 | 99–114 | PFYDTLTSYVLPYLTH (SEQ ID NO: 2229) |
| I096C09 | 245 | 141–251 | 166–177 | 193–199 | 232–240 | 1–125 | 26–35 | 50–66 | 99–114 | PFYDTLTSYVFQYFDH (SEQ ID NO: 2137) |
| I096D01 | 246 | 141–251 | 166–177 | 193–199 | 232–240 | 1–125 | 26–35 | 50–66 | 99–114 | PFYDTLTSYVFQYFDH (SEQ ID NO: 2137) |
| I096D02 | 247 | 141–251 | 166–177 | 193–199 | 232–240 | 1–125 | 26–35 | 50–66 | 99–114 | PFYDTLTSYVFQYFDH (SEQ ID NO: 2137) |
| I096D05 | 248 | 141–251 | 166–177 | 193–199 | 232–240 | 1–125 | 26–35 | 50–66 | 99–114 | PFYDTLTSYVFQYFDH (SEQ ID NO: 2137) |
| I096D06 | 249 | 141–251 | 166–177 | 193–199 | 232–240 | 1–125 | 26–35 | 50–66 | 99–114 | PFYDTLTSYVFQYFDH (SEQ ID NO: 2137) |
| I096D09 | 250 | 141–251 | 166–177 | 193–199 | 232–240 | 1–125 | 26–35 | 50–66 | 99–114 | PFYDTLTSYVFQYFDH (SEQ ID NO: 2137) |
| I096E02 | 251 | 141–251 | 166–177 | 193–199 | 232–240 | 1–125 | 26–35 | 50–66 | 99–114 | PFYDTLTSYVLGFYPV (SEQ ID NO: 2329) |
| I096E06 | 252 | 141–251 | 166–177 | 193–199 | 232–240 | 1–125 | 26–35 | 50–66 | 99–114 | PFYDTLTSYVLHYHTH (SEQ ID NO: 2336) |
| I096E11 | 253 | 141–251 | 166–177 | 193–199 | 232–240 | 1–125 | 26–35 | 50–66 | 99–114 | PFYDTLTSYVFQYFDH (SEQ ID NO: 2137) |
| I096F02 | 254 | 141–251 | 166–177 | 193–199 | 232–240 | 1–125 | 26–35 | 50–66 | 99–114 | PFYDTLTSYVIHFLPL (SEQ ID NO: 2330) |
| I096G01 | 255 | 141–251 | 166–177 | 193–199 | 232–240 | 1–125 | 26–35 | 50–66 | 99–114 | PFYDTLTSYVIPFLPL (SEQ ID NO: 2290) |
| I096G02 | 256 | 141–251 | 166–177 | 193–199 | 232–240 | 1–125 | 26–35 | 50–66 | 99–114 | PFYDTLTSYVFQYFDH (SEQ ID NO: 2137) |
| I096G05 | 257 | 141–251 | 166–177 | 193–199 | 232–240 | 1–125 | 26–35 | 50–66 | 99–114 | PFYDTLTSYVFQYFDH (SEQ ID NO: 2137) |
| I096G07 | 258 | 141–251 | 166–177 | 193–199 | 232–240 | 1–125 | 26–35 | 50–66 | 99–114 | PFYDTLTSYVFQYFDH (SEQ ID NO: 2137) |
| I096G09 | 259 | 141–251 | 166–177 | 193–199 | 232–240 | 1–125 | 26–35 | 50–66 | 99–114 | PFYDTLTSYVMHYLPV (SEQ ID NO: 2257) |
| I096G12 | 260 | 141–251 | 166–177 | 193–199 | 232–240 | 1–125 | 26–35 | 50–66 | 99–114 | PFYDTLTSYVLEFFSH (SEQ ID NO: 2315) |
| I096H01 | 261 | 137–244 | 160–170 | 186–192 | 225–233 | 1–121 | 26–35 | 50–66 | 99–110 | ASYLSTSSSLDN (SEQ ID NO: 2265) |
| I097A04 | 262 | 141–251 | 166–177 | 193–199 | 232–240 | 1–125 | 26–35 | 50–66 | 99–114 | PFYDTLTSYVIHYLVT (SEQ ID NO: 2294) |
| I097A06 | 263 | 141–251 | 166–177 | 193–199 | 232–240 | 1–125 | 26–35 | 50–66 | 99–114 | PFYDTLTSYVLPYYTL (SEQ ID NO: 2231) |
| I097A09 | 264 | 141–251 | 166–177 | 193–199 | 232–240 | 1–125 | 26–35 | 50–66 | 99–114 | PFYDTLTSYVLHYYPI (SEQ ID NO: 2298) |
| I097B02 | 265 | 141–251 | 166–177 | 193–199 | 232–240 | 1–125 | 26–35 | 50–66 | 99–114 | PFYDTLTSYVLWFYPL (SEQ ID NO: 2247) |
| I097B09 | 266 | 141–251 | 166–177 | 193–199 | 232–240 | 1–125 | 26–35 | 50–66 | 99–114 | PFYDTLTSYVFQYFDH (SEQ ID NO: 2137) |
| I097B10 | 267 | 141–251 | 166–177 | 193–199 | 232–240 | 1–125 | 26–35 | 50–66 | 99–114 | PFYDTLTSYVFQYFDH (SEQ ID NO: 2137) |
| I097B11 | 268 | 141–251 | 166–177 | 193–199 | 232–240 | 1–125 | 26–35 | 50–66 | 99–114 | PFYDTLTSYVFQYFDH (SEQ ID NO: 2137) |
| I097C05 | 269 | 141–251 | 166–177 | 193–199 | 232–240 | 1–125 | 26–35 | 50–66 | 99–114 | PFYDTLTSYVLHYYTH (SEQ ID NO: 2219) |
| I097C09 | 270 | 141–251 | 166–177 | 193–199 | 232–240 | 1–125 | 26–35 | 50–66 | 99–114 | PFYDTLTSYVLHYYAY (SEQ ID NO: 2316) |
| I097C11 | 271 | 141–251 | 166–177 | 193–199 | 232–240 | 1–125 | 26–35 | 50–66 | 99–114 | PFYDTLTSYVFQYFDH (SEQ ID NO: 2137) |
| I097D05 | 272 | 141–251 | 166–177 | 193–199 | 232–240 | 1–125 | 26–35 | 50–66 | 99–114 | PFYDTLTSYVIHFYSL (SEQ ID NO: 2293) |
| I097D06 | 273 | 141–251 | 166–177 | 193–199 | 232–240 | 1–125 | 26–35 | 50–66 | 99–114 | PFYDTLTSYVFGFFPH (SEQ ID NO: 2300) |
| I097E01 | 274 | 141–251 | 166–177 | 193–199 | 232–240 | 1–125 | 26–35 | 50–66 | 99–114 | PFYDTLTSYVFQYFDH (SEQ ID NO: 2137) |
| I097E04 | 275 | 141–251 | 166–177 | 193–199 | 232–240 | 1–125 | 26–35 | 50–66 | 99–114 | PFYDTLTSYVFQYFDH (SEQ ID NO: 2137) |
| I097E08 | 276 | 141–251 | 166–177 | 193–199 | 232–240 | 1–125 | 26–35 | 50–66 | 99–114 | PFYDTLTSYVFQYFDH (SEQ ID NO: 2137) |
| I097E09 | 277 | 141–251 | 166–177 | 193–199 | 232–240 | 1–125 | 26–35 | 50–66 | 99–114 | PFYDTLTSYVFQYFDH (SEQ ID NO: 2137) |
| I097F09 | 278 | 141–251 | 166–177 | 193–199 | 232–240 | 1–125 | 26–35 | 50–66 | 99–114 | PFYDTLTSYVFQYFDH (SEQ ID NO: 2137) |
| I097G10 | 279 | 141–251 | 166–177 | 193–199 | 232–240 | 1–125 | 26–35 | 50–66 | 99–114 | PFYDTLTSYVFQYFAH (SEQ ID NO: 2268) |
| I097H02 | 280 | 137–244 | 160–170 | 186–192 | 225–233 | 1–121 | 26–35 | 50–66 | 99–110 | ASYLSTSSSLDN (SEQ ID NO: 2265) |
| I098A04 | 281 | 141–251 | 166–177 | 193–199 | 232–240 | 1–125 | 26–35 | 50–66 | 99–114 | PFYDTLTSYVFQYFDH (SEQ ID NO: 2137) |

TABLE 1-continued scFvs that Immunospecifically Bind to BLyS

| Clone ID | scFv SEQ ID NO | AAs of VL | AAs of VL CDR1 | AAs of VL CDR2 | AAs of VL CDR3 | AAs of VH | AAs of VH CDR1 | AAs of VH CDR2 | AAs of VH CDR3 | VH CDR3 Sequence (SEQ ID NO) |
|---|---|---|---|---|---|---|---|---|---|---|
| I098A05 | 282 | 141–251 | 166–177 | 193–199 | 232–240 | 1–125 | 26–35 | 50–66 | 99–114 | PFYDTLTSYVFQYFDH (SEQ ID NO: 2137) |
| I098B08 | 283 | 141–251 | 166–177 | 193–199 | 232–240 | 1–125 | 26–35 | 50–66 | 99–114 | PFYDTLTSYVLDFYSV (SEQ ID NO: 2308) |
| I098C01 | 284 | 141–251 | 166–177 | 193–199 | 232–240 | 1–125 | 26–35 | 50–66 | 99–114 | PIYDTLTSYVFQYFDH (SEQ ID NO: 2278) |
| I098C04 | 285 | 141–251 | 166–177 | 193–199 | 232–240 | 1–125 | 26–35 | 50–66 | 99–114 | PFYDTLTSYVLYYYAF (SEQ ID NO: 2251) |
| I098F11 | 286 | 141–251 | 166–177 | 193–199 | 232–240 | 1–125 | 26–35 | 50–66 | 99–114 | PFYDTLTSYVFQYFDH (SEQ ID NO: 2137) |
| I098F12 | 287 | 141–251 | 166–177 | 193–199 | 232–240 | 1–125 | 26–35 | 50–66 | 99–114 | PFYDTLTSYVFFFYPF (SEQ ID NO: 2250) |
| I098G02 | 288 | 141–251 | 166–177 | 193–199 | 232–240 | 1–125 | 26–35 | 50–66 | 99–114 | PFYDTLTSYVFQYFDH (SEQ ID NO: 2137) |
| I098G12 | 289 | 141–251 | 166–177 | 193–199 | 232–240 | 1–125 | 26–35 | 50–66 | 99–114 | PFYDTLTSYVFQYFDH (SEQ ID NO: 2137) |
| I098H05 | 290 | 141–251 | 166–177 | 193–199 | 232–240 | 1–125 | 26–35 | 50–66 | 99–114 | PFYDTLTSYVFQYFDH (SEQ ID NO: 2137) |
| I101A01 | 291 | 141–251 | 166–177 | 193–199 | 232–240 | 1–125 | 26–35 | 50–66 | 99–114 | PFYDTLTSYVFQYFDH (SEQ ID NO: 2137) |
| I101B04 | 292 | 141–251 | 166–177 | 193–199 | 232–240 | 1–125 | 26–35 | 50–66 | 99–114 | PFYDTLTSYVFQYFDH (SEQ ID NO: 2137) |
| I101B06 | 293 | 141–251 | 166–177 | 193–199 | 232–240 | 1–125 | 26–35 | 50–66 | 99–114 | PFYDTLTSYVIPFLTH (SEQ ID NO: 2304) |
| I101D04 | 294 | 141–251 | 166–177 | 193–199 | 232–240 | 1–125 | 26–35 | 50–66 | 99–114 | PFYDTLTSYVLEFFPD (SEQ ID NO: 2313) |
| I101D07 | 295 | 141–251 | 166–177 | 193–199 | 232–240 | 1–125 | 26–35 | 50–66 | 99–114 | PFYDTLTSYVFQYFDH (SEQ ID NO: 2137) |
| I101E09 | 296 | 141–251 | 166–177 | 193–199 | 232–240 | 1–125 | 26–35 | 50–66 | 99–114 | PFYDTLTSYVFQYFDR (SEQ ID NO: 2279) |
| I101E12 | 297 | 141–251 | 166–177 | 193–199 | 232–240 | 1–125 | 26–35 | 50–66 | 99–114 | PFYDTLTSYVFQYFDH (SEQ ID NO: 2137) |
| I101G02 | 298 | 141–251 | 166–177 | 193–199 | 232–240 | 1–125 | 26–35 | 50–66 | 99–114 | PFYDTLTSYVFQYFDH (SEQ ID NO: 2137) |
| I101G11 | 299 | 141–251 | 166–177 | 193–199 | 232–240 | 1–125 | 26–35 | 50–66 | 99–114 | PFYDTLTSYVFQYFDH (SEQ ID NO: 2137) |
| I102C03 | 300 | 141–251 | 166–177 | 193–199 | 232–240 | 1–125 | 26–35 | 50–66 | 99–114 | PFYDTLTSYVFQYFDH (SEQ ID NO: 2137) |
| I102E09 | 301 | 141–251 | 166–177 | 193–199 | 232–240 | 1–125 | 26–35 | 50–66 | 99–114 | PFYDTLTSYVFQYFDH (SEQ ID NO: 2137) |
| I102F02 | 302 | 141–251 | 166–177 | 193–199 | 232–240 | 1–125 | 26–35 | 50–66 | 99–114 | PFYDTLTSYVFQYFDH (SEQ ID NO: 2137) |
| I102G08 | 303 | 141–251 | 166–177 | 193–199 | 232–240 | 1–125 | 26–35 | 50–66 | 99–114 | PFYDTLTSYVFQYFDH (SEQ ID NO: 2137) |
| I102G09 | 304 | 141–251 | 166–177 | 193–199 | 232–240 | 1–125 | 26–35 | 50–66 | 99–114 | PFYDTLTSYVLHYYAH (SEQ ID NO: 2214) |
| I106A09 | 305 | 141–251 | 166–177 | 193–199 | 232–240 | 1–125 | 26–35 | 50–66 | 99–114 | PFYDTLTSYVFQYFDH (SEQ ID NO: 2137) |
| I106B02 | 306 | 141–251 | 166–177 | 193–199 | 232–240 | 1–125 | 26–35 | 50–66 | 99–114 | PFYDTLTSYVFQYFDH (SEQ ID NO: 2137) |
| I106B06 | 307 | 141–251 | 166–177 | 193–199 | 232–240 | 1–125 | 26–35 | 50–66 | 99–114 | PFYDTLTSYVFQYFDH (SEQ ID NO: 2137) |
| I106C07 | 308 | 141–251 | 166–177 | 193–199 | 232–240 | 1–125 | 26–35 | 50–66 | 99–114 | PFYDTLTSYVFQYFDH (SEQ ID NO: 2137) |
| I106E05 | 309 | 141–251 | 166–177 | 193–199 | 232–240 | 1–125 | 26–35 | 50–66 | 99–114 | PFYDTLTSYVFQYFDH (SEQ ID NO: 2137) |
| I106E12 | 310 | 141–251 | 166–177 | 193–199 | 232–240 | 1–125 | 26–35 | 50–66 | 99–114 | PFYDTLTSYVFQYFDH (SEQ ID NO: 2137) |
| I106G01 | 311 | 141–251 | 166–177 | 193–199 | 232–240 | 1–125 | 26–35 | 50–66 | 99–114 | PFYDTLTSYVFQYFDH (SEQ ID NO: 2137) |
| I106G03 | 312 | 141–251 | 166–177 | 193–199 | 232–240 | 1–125 | 26–35 | 50–66 | 99–114 | PFYDTLTSYVFQYFDH (SEQ ID NO: 2137) |
| I109B06 | 313 | 141–251 | 166–177 | 193–199 | 232–240 | 1–125 | 26–35 | 50–66 | 99–114 | PFYDTLTSYVFQYFDH (SEQ ID NO: 2137) |
| I109D12 | 314 | 141–251 | 166–177 | 193–199 | 232–240 | 1–125 | 26–35 | 50–66 | 99–114 | PFYDTLTSYVFQYFDH (SEQ ID NO: 2137) |
| I109E12 | 315 | 141–251 | 166–177 | 193–199 | 232–240 | 1–125 | 26–35 | 50–66 | 99–114 | PFYDTLTSYVFQYFDH (SEQ ID NO: 2137) |
| I109G06 | 316 | 141–251 | 166–177 | 193–199 | 232–240 | 1–125 | 26–35 | 50–66 | 99–114 | PFYDTLTSYVFQYFDH (SEQ ID NO: 2137) |
| I109H04 | 317 | 141–251 | 166–177 | 193–199 | 232–240 | 1–125 | 26–35 | 50–66 | 99–114 | PFYDTLTSYVFQYFDH (SEQ ID NO: 2137) |
| I110B03 | 318 | 141–251 | 166–177 | 193–199 | 232–240 | 1–125 | 26–35 | 50–66 | 99–114 | PFYDTLTSYVFQYFDH (SEQ ID NO: 2137) |
| I112D09 | 319 | 141–251 | 166–177 | 193–199 | 232–240 | 1–125 | 26–35 | 50–66 | 99–114 | PFYDTLTSYGFQYFDH (SEQ ID NO: 2232) |
| I112F10 | 320 | 141–251 | 166–177 | 193–199 | 232–240 | 1–125 | 26–35 | 50–66 | 99–114 | PFYDTLTSYVFQYFDH (SEQ ID NO: 2137) |
| I089F12 | 321 | 139–249 | 163–173 | 189–195 | 228–238 | 1–123 | 26–35 | 50–66 | 99–112 | SRDLLLFPHHGLDS (SEQ ID NO: 2146) |
| I105E12 | 322 | 139–249 | 163–173 | 189–195 | 228–238 | 1–123 | 26–35 | 50–66 | 99–112 | SRDLLLFPHHSFDL (SEQ ID NO: 2147) |
| I108D08 | 323 | 139–249 | 163–173 | 189–195 | 228–238 | 1–123 | 26–35 | 50–66 | 99–112 | SRDLLLFPLAPLYP (SEQ ID NO: 2148) |
| I108E06 | 324 | 139–249 | 163–173 | 189–195 | 228–238 | 1–123 | 26–35 | 50–66 | 99–112 | SRDLLLFPHHGLDV (SEQ ID NO: 2151) |
| I113E07 | 325 | 139–249 | 163–173 | 189–195 | 228–238 | 1–123 | 26–35 | 50–66 | 99–112 | SRDLLLFPHHSLDL (SEQ ID NO: 2152) |
| I114G05 | 326 | 139–249 | 163–173 | 189–195 | 228–238 | 1–123 | 26–35 | 50–66 | 99–112 | SRDLLLFPHHSFDL (SEQ ID NO: 2147) |
| I116A01 | 327 | 139–249 | 163–173 | 189–195 | 228–238 | 1–123 | 26–35 | 50–66 | 99–112 | SRDLLLFPHHALSP (SEQ ID NO: 2149) |
| I116A09 | 328 | 139–249 | 163–173 | 189–195 | 228–238 | 1–123 | 26–35 | 50–66 | 99–112 | SRYLLLFPHHSFDL (SEQ ID NO: 2150) |

TABLE 1-continued scFvs that Immunospecifically Bind to BLyS

| Clone ID | scFv SEQ ID NO | AAs of VL | AAs of VL CDR1 | AAs of VL CDR2 | AAs of VL CDR3 | AAs of VH | AAs of VH CDR1 | AAs of VH CDR2 | AAs of VH CDR3 | VH CDR3 Sequence (SEQ ID NO) |
|---|---|---|---|---|---|---|---|---|---|---|
| I116C11 | 329 | 139–249 | 163–173 | 189–195 | 228–238 | 1–123 | 26–35 | 50–66 | 99–112 | SRDLLLFPHHSFDL (SEQ ID NO: 2147) |
| I085A01 | 330 | 139–249 | 163–173 | 189–195 | 228–238 | 1–123 | 26–35 | 50–66 | 99–112 | SRDLLLFPHDHLLF (SEQ ID NO: 2602) |
| I085A02 | 331 | 139–249 | 163–173 | 189–195 | 228–238 | 1–123 | 26–35 | 50–66 | 99–112 | SRDLLLFPSDPLGF (SEQ ID NO: 2639) |
| I085A03 | 332 | 139–249 | 163–173 | 189–195 | 228–238 | 1–123 | 26–35 | 50–66 | 99–112 | SRDLLLFPTHPLSF (SEQ ID NO: 2561) |
| I085A04 | 333 | 139–249 | 163–173 | 189–195 | 228–238 | 1–123 | 26–35 | 50–66 | 99–112 | SRDLLLFPLAPLFF (SEQ ID NO: 2550) |
| I085A05 | 334 | 139–249 | 163–173 | 189–195 | 228–238 | 1–123 | 26–35 | 50–66 | 99–112 | SRDLLLFPSDPLSL (SEQ ID NO: 2659) |
| I085A06 | 335 | 139–249 | 163–173 | 189–195 | 228–238 | 1–123 | 26–35 | 50–66 | 99–112 | SRDLLLFPSAPLSF (SEQ ID NO: 2611) |
| I085A07 | 336 | 139–249 | 163–173 | 189–195 | 228–238 | 1–123 | 26–35 | 50–66 | 99–112 | SRDLLLFPASPLSF (SEQ ID NO: 2390) |
| I085A09 | 337 | 138–248 | 162–172 | 188–194 | 227–237 | 1–122 | 26–35 | 50–66 | 99–111 | SRDLLLFPNDALS (SEQ ID NO: 2632) |
| I085A10 | 338 | 139–249 | 163–173 | 189–195 | 228–238 | 1–123 | 26–35 | 50–66 | 99–112 | SRDLLLFPSAPLRF (SEQ ID NO: 2609) |
| I085A11 | 339 | 138–248 | 162–172 | 188–194 | 227–237 | 1–122 | 26–35 | 50–66 | 99–111 | SRDLLLFPHDPLE (SEQ ID NO: 2363) |
| I085B01 | 340 | 139–249 | 163–173 | 189–195 | 228–238 | 1–123 | 26–35 | 50–66 | 99–112 | SRDLLLFPQSPLYP (SEQ ID NO: 2466) |
| I085B02 | 341 | 139–249 | 163–173 | 189–195 | 228–238 | 1–123 | 26–35 | 50–66 | 99–112 | SRDLLLFPHSSLVF (SEQ ID NO: 2392) |
| I085B03 | 342 | 139–249 | 163–173 | 189–195 | 228–238 | 1–123 | 26–35 | 50–66 | 99–112 | SRDLLLFPYDPLLF (SEQ ID NO: 2638) |
| I085B04 | 343 | 139–249 | 163–173 | 189–195 | 228–238 | 1–123 | 26–35 | 50–66 | 99–112 | SRDLLLFPHAPLYF (SEQ ID NO: 2589) |
| I085B05 | 344 | 139–249 | 163–173 | 189–195 | 228–238 | 1–123 | 26–35 | 50–66 | 99–112 | SRDLLLFPHAPLSP (SEQ ID NO: 2573) |
| I085B06 | 345 | 139–249 | 163–173 | 189–195 | 228–238 | 1–123 | 26–35 | 50–66 | 99–112 | SRDLLLFPLSPLSF (SEQ ID NO: 2574) |
| I085B07 | 346 | 139–249 | 163–173 | 189–195 | 228–238 | 1–123 | 26–35 | 50–66 | 99–112 | SRDLLLFPDFPMAP (SEQ ID NO: 2433) |
| I085B10 | 347 | 138–248 | 162–172 | 188–194 | 227–237 | 1–122 | 26–35 | 50–66 | 99–111 | SRDLLLFPHSPLY (SEQ ID NO: 2470) |
| I085B12 | 348 | 139–249 | 163–173 | 189–195 | 228–238 | 1–123 | 26–35 | 50–66 | 99–112 | SRDLLLFPQDPLSP (SEQ ID NO: 2372) |
| I085C02 | 349 | 139–249 | 163–173 | 189–195 | 228–238 | 1–123 | 26–35 | 50–66 | 99–112 | SRDLLLFPDDPLLS (SEQ ID NO: 2430) |
| I085C03 | 350 | 139–249 | 163–173 | 189–195 | 228–238 | 1–123 | 26–35 | 50–66 | 99–112 | SRDLLLFPHGPLLI (SEQ ID NO: 2400) |
| I085C05 | 351 | 139–249 | 163–173 | 189–195 | 228–238 | 1–123 | 26–35 | 50–66 | 99–112 | SRDLLLFPGSPLLF (SEQ ID NO: 2491) |
| I085C06 | 352 | 139–249 | 163–173 | 189–195 | 228–238 | 1–123 | 26–35 | 50–66 | 99–112 | SRDLLLFPTAALSF (SEQ ID NO: 2341) |
| I085C07 | 353 | 139–249 | 163–173 | 189–195 | 228–238 | 1–123 | 26–35 | 50–66 | 99–112 | SRDLLLFPHTPLRF (SEQ ID NO: 2375) |
| I085C09 | 354 | 138–248 | 162–172 | 188–194 | 227–237 | 1–122 | 26–35 | 50–66 | 99–111 | SRDLLLFPHSPLT (SEQ ID NO: 2468) |
| I085C10 | 355 | 139–249 | 163–173 | 189–195 | 228–238 | 1–123 | 26–35 | 50–66 | 99–112 | SRDLLLFPFSPLLF (SEQ ID NO: 2471) |
| I085C12 | 356 | 139–249 | 163–173 | 189–195 | 228–238 | 1–123 | 26–35 | 50–66 | 99–112 | SRDLLLFPSHPLFF (SEQ ID NO: 2680) |
| I085D01 | 357 | 139–249 | 163–173 | 189–195 | 228–238 | 1–123 | 26–35 | 50–66 | 99–112 | SRDLLLFPRPLLLF (SEQ ID NO: 2548) |
| I085D02 | 358 | 139–249 | 163–173 | 189–195 | 228–238 | 1–123 | 26–35 | 50–66 | 99–112 | SRDLLLFPSQYLDF (SEQ ID NO: 2523) |
| I085D03 | 359 | 139–249 | 163–173 | 189–195 | 228–238 | 1–123 | 26–35 | 50–66 | 99–112 | SRDLLLFPSSPLLF (SEQ ID NO: 2713) |
| I085D04 | 360 | 139–249 | 163–173 | 189–195 | 228–238 | 1–123 | 26–35 | 50–66 | 99–112 | SRDLLLFPYFPLVF (SEQ ID NO: 2646) |
| I085D06 | 361 | 139–249 | 163–173 | 189–195 | 228–238 | 1–123 | 26–35 | 50–66 | 99–112 | SRDLLLFPGSPLLD (SEQ ID NO: 2488) |
| I085D07 | 362 | 139–249 | 163–173 | 189–195 | 228–238 | 1–123 | 26–35 | 50–66 | 99–112 | SRDLLLFPQAPLLF (SEQ ID NO: 2694) |
| I085D08 | 363 | 139–249 | 163–173 | 189–195 | 228–238 | 1–123 | 26–35 | 50–66 | 99–112 | SRDLLLFPHSYLSP (SEQ ID NO: 2477) |
| I085D09 | 364 | 139–249 | 163–173 | 189–195 | 228–238 | 1–123 | 26–35 | 50–66 | 99–112 | SRDLLLFPQTPLFP (SEQ ID NO: 2467) |
| I085D10 | 365 | 139–249 | 163–173 | 189–195 | 228–238 | 1–123 | 26–35 | 50–66 | 99–112 | SRDLLLFPHSPLHP (SEQ ID NO: 2563) |
| I085D11 | 366 | 139–249 | 163–173 | 189–195 | 228–238 | 1–123 | 26–35 | 50–66 | 99–112 | SRDLLLFPHAPLAP (SEQ ID NO: 2510) |
| I085D12 | 367 | 139–249 | 163–173 | 189–195 | 228–238 | 1–123 | 26–35 | 50–66 | 99–112 | SRDLLLFPHTTLRF (SEQ ID NO: 2495) |
| I085E01 | 368 | 139–249 | 163–173 | 189–195 | 228–238 | 1–123 | 26–35 | 50–66 | 99–112 | SRDLLLFPYAVLHF (SEQ ID NO: 2620) |
| I085E02 | 369 | 139–249 | 163–173 | 189–195 | 228–238 | 1–123 | 26–35 | 50–66 | 99–112 | SRDLLLFPTSPLRL (SEQ ID NO: 2575) |
| I085E07 | 370 | 139–249 | 163–173 | 189–195 | 228–238 | 1–123 | 26–35 | 50–66 | 99–112 | SRDLLLFPSDALSF (SEQ ID NO: 2568) |
| I085E08 | 371 | 139–249 | 163–173 | 189–195 | 228–238 | 1–123 | 26–35 | 50–66 | 99–112 | SRDLLLFPNAPLDP (SEQ ID NO: 2603) |
| I085E09 | 372 | 139–249 | 163–173 | 189–195 | 228–238 | 1–123 | 26–35 | 50–66 | 99–112 | SRDLLLFPHDPPRF (SEQ ID NO: 2628) |
| I085E10 | 373 | 139–249 | 163–173 | 189–195 | 228–238 | 1–123 | 26–35 | 50–66 | 99–112 | SRDLLLFPSEPLWP (SEQ ID NO: 2668) |
| I085E11 | 374 | 139–249 | 163–173 | 189–195 | 228–238 | 1–123 | 26–35 | 50–66 | 99–112 | SRDLLLFPSSPLSN (SEQ ID NO: 2716) |
| I085E12 | 375 | 139–249 | 163–173 | 189–195 | 228–238 | 1–123 | 26–35 | 50–66 | 99–112 | SRDLLLFPHLPLTP (SEQ ID NO: 2431) |

TABLE 1-continued scFvs that Immunospecifically Bind to BLyS

| Clone ID | scFv SEQ ID NO | AAs of VL | AAs of VL CDR1 | AAs of VL CDR2 | AAs of VL CDR3 | AAs of VH | AAs of VH CDR1 | AAs of VH CDR2 | AAs of VH CDR3 | VH CDR3 Sequence (SEQ ID NO) |
|---|---|---|---|---|---|---|---|---|---|---|
| I085F01 | 376 | 139–249 | 163–173 | 189–195 | 228–238 | 1–123 | 26–35 | 50–66 | 99–112 | SRDLLLFPRSPLLF (SEQ ID NO: 2551) |
| I085F02 | 377 | 139–249 | 163–173 | 189–195 | 228–238 | 1–123 | 26–35 | 50–66 | 99–112 | SRDLLLFPTSPLQL (SEQ ID NO: 2376) |
| I085F03 | 378 | 139–249 | 163–173 | 189–195 | 228–238 | 1–123 | 26–35 | 50–66 | 99–112 | SRDLLLFPYTPLLF (SEQ ID NO: 2682) |
| I085F04 | 379 | 139–249 | 163–173 | 189–195 | 228–238 | 1–123 | 26–35 | 50–66 | 99–112 | SRDLLLFPSSPLAF (SEQ ID NO: 2707) |
| I085F05 | 380 | 139–249 | 163–173 | 189–195 | 228–238 | 1–123 | 26–35 | 50–66 | 99–112 | SRDLLLFPHDPLYF (SEQ ID NO: 2706) |
| I085F06 | 381 | 139–249 | 163–173 | 189–195 | 228–238 | 1–123 | 26–35 | 50–66 | 99–112 | SRDLLLFPSAHLLF (SEQ ID NO: 2586) |
| I085F07 | 382 | 139–249 | 163–173 | 189–195 | 228–238 | 1–123 | 26–35 | 50–66 | 99–112 | SPDLLLFPAGPLRF (SEQ ID NO: 2410) |
| I085F09 | 383 | 139–249 | 163–173 | 189–195 | 228–238 | 1–123 | 26–35 | 50–66 | 99–112 | SRDLLLFPDHAFFV (SEQ ID NO: 2439) |
| I085F10 | 384 | 139–249 | 163–173 | 189–195 | 228–238 | 1–123 | 26–35 | 50–66 | 99–112 | SRDLLLFPSDSGFA (SEQ ID NO: 2662) |
| I085F11 | 385 | 139–249 | 163–173 | 189–195 | 228–238 | 1–123 | 26–35 | 50–66 | 99–112 | SRDLLLFPSSYLEF (SEQ ID NO: 2339) |
| I085F12 | 386 | 139–249 | 163–173 | 189–195 | 228–238 | 1–123 | 26–35 | 50–66 | 99–112 | SRDLLLFPRDPLII (SEQ ID NO: 2558) |
| I085G01 | 387 | 139–249 | 163–173 | 189–195 | 228–238 | 1–123 | 26–35 | 50–66 | 99–112 | SRDLLLFPSAPLHP (SEQ ID NO: 2605) |
| I085G02 | 388 | 139–249 | 163–173 | 189–195 | 228–238 | 1–123 | 26–35 | 50–66 | 99–112 | SRDLLLFPNAPLLL (SEQ ID NO: 2613) |
| I085G03 | 389 | 139–249 | 163–173 | 189–195 | 228–238 | 1–123 | 26–35 | 50–66 | 99–112 | SRDLLLFPAAPLLF (SEQ ID NO: 2403) |
| I085G04 | 390 | 139–249 | 163–173 | 189–195 | 228–238 | 1–123 | 26–35 | 50–66 | 99–112 | SRDLLLFPSAPLDP (SEQ ID NO: 2601) |
| I085G07 | 391 | 139–249 | 163–173 | 189–195 | 228–238 | 1–123 | 26–35 | 50–66 | 99–112 | SRDLLLFPNAVLDI (SEQ ID NO: 2629) |
| I085G08 | 392 | 139–249 | 163–173 | 189–195 | 228–238 | 1–123 | 26–35 | 50–66 | 99–112 | SRDLLLFPSEPLFF (SEQ ID NO: 2664) |
| I085G09 | 393 | 139–249 | 163–173 | 189–195 | 228–238 | 1–123 | 26–35 | 50–66 | 99–112 | SRDLLLFPSSVLWP (SEQ ID NO: 2338) |
| I085G10 | 394 | 138–248 | 162–172 | 188–194 | 227–237 | 1–122 | 26–35 | 50–66 | 99–111 | SRDLLLFPHAPLQ (SEQ ID NO: 2554) |
| I085G11 | 395 | 139–249 | 163–173 | 189–195 | 228–238 | 1–123 | 26–35 | 50–66 | 99–112 | SRDLLLFPDSPLAP (SEQ ID NO: 2445) |
| I085G12 | 396 | 139–249 | 163–173 | 189–195 | 228–238 | 1–123 | 26–35 | 50–66 | 99–112 | SRDLLLFPSSPLHP (SEQ ID NO: 2576) |
| I085H10 | 397 | 142–249 | 163–173 | 189–195 | 228–238 | 1–126 | 26–35 | 50–66 | 99–115 | DGYYDILTGYSYYGMDV (SEQ ID NO: 2135) |
| I086A03 | 398 | 139–249 | 163–173 | 189–195 | 228–238 | 1–123 | 26–35 | 50–66 | 99–112 | SRDLLLFPSMPLTF (SEQ ID NO: 2695) |
| I086A04 | 399 | 139–249 | 163–173 | 189–195 | 228–238 | 1–123 | 26–35 | 50–66 | 99–112 | SRDLLLFPHSILHP (SEQ ID NO: 2438) |
| I086A05 | 400 | 139–249 | 163–173 | 189–195 | 228–238 | 1–123 | 26–35 | 50–66 | 99–112 | SRDLLLFPHAPLSH (SEQ ID NO: 2569) |
| I086A07 | 401 | 139–249 | 163–173 | 189–195 | 228–238 | 1–123 | 26–35 | 50–66 | 99–112 | SRDLLLFPDAALRF (SEQ ID NO: 2421) |
| I086A09 | 402 | 139–249 | 163–173 | 189–195 | 228–238 | 1–123 | 26–35 | 50–66 | 99–112 | SRDLLLFPSSHLSF (SEQ ID NO: 2704) |
| I086A10 | 403 | 139–249 | 163–173 | 189–195 | 228–238 | 1–123 | 26–35 | 50–66 | 99–112 | SRDLLLFPSAPLSS (SEQ ID NO: 2624) |
| I086A11 | 404 | 139–249 | 163–173 | 189–195 | 228–238 | 1–123 | 26–35 | 50–66 | 99–112 | SRDLLLFPHAPLTP (SEQ ID NO: 2577) |
| I086A12 | 405 | 139–249 | 163–173 | 189–195 | 228–238 | 1–123 | 26–35 | 50–66 | 99–112 | SRDLLLFPYDPLHS (SEQ ID NO: 2635) |
| I086B02 | 406 | 139–249 | 163–173 | 189–195 | 228–238 | 1–123 | 26–35 | 50–66 | 99–112 | SRDLLLFPHFPLHP (SEQ ID NO: 2348) |
| I086B03 | 407 | 139–249 | 163–173 | 189–195 | 228–238 | 1–123 | 26–35 | 50–66 | 99–112 | SRDLLLFPAHPLLF (SEQ ID NO: 2412) |
| I086B05 | 408 | 139–249 | 163–173 | 189–195 | 228–238 | 1–123 | 26–35 | 50–66 | 99–112 | SRDLLLFPFEPLII (SEQ ID NO: 2457) |
| I086B06 | 409 | 139–249 | 163–173 | 189–195 | 228–238 | 1–123 | 26–35 | 50–66 | 99–112 | SRDLLLFPASPLNP (SEQ ID NO: 2364) |
| I086B07 | 410 | 139–249 | 163–173 | 189–195 | 228–238 | 1–123 | 26–35 | 50–66 | 99–112 | SRDLLLFPSSPLYF (SEQ ID NO: 2720) |
| I086B09 | 411 | 139–249 | 163–173 | 189–195 | 228–238 | 1–123 | 26–35 | 50–66 | 99–112 | SRDLLLFPTSPLSF (SEQ ID NO: 2579) |
| I086B10 | 412 | 139–249 | 163–173 | 189–195 | 228–238 | 1–123 | 26–35 | 50–66 | 99–112 | SRDLLLFPDDGLSS (SEQ ID NO: 2428) |
| I086B11 | 413 | 139–249 | 163–173 | 189–195 | 228–238 | 1–123 | 26–35 | 50–66 | 99–112 | SRDLLLFPISPLCF (SEQ ID NO: 2530) |
| I086C03 | 414 | 139–249 | 163–173 | 189–195 | 228–238 | 1–123 | 26–35 | 50–66 | 99–112 | SRDLLLFPTAPLYG (SEQ ID NO: 2535) |
| I086C05 | 415 | 139–249 | 163–173 | 189–195 | 228–238 | 1–123 | 26–35 | 50–66 | 99–112 | SRDLLLFPHHSLFF (SEQ ID NO: 2427) |
| I086C07 | 416 | 139–249 | 163–173 | 189–195 | 228–238 | 1–123 | 26–35 | 50–66 | 99–112 | SRDLLLFPQGPLRF (SEQ ID NO: 2440) |
| I086C08 | 417 | 139–249 | 163–173 | 189–195 | 228–238 | 1–123 | 26–35 | 50–66 | 99–112 | SRDLLLFPAAPLAF (SEQ ID NO: 2401) |
| I086C09 | 418 | 139–249 | 163–173 | 189–195 | 228–238 | 1–123 | 26–35 | 50–66 | 99–112 | SRDLLLFPHLPLLF (SEQ ID NO: 2350) |
| I086C10 | 419 | 139–249 | 163–173 | 189–195 | 228–238 | 1–123 | 26–35 | 50–66 | 99–112 | SRDLLLFPTFPLIF (SEQ ID NO: 2541) |
| I086C11 | 420 | 139–249 | 163–173 | 189–195 | 228–238 | 1–123 | 26–35 | 50–66 | 99–112 | SRDLLLFPDDPLSF (SEQ ID NO: 2432) |
| I086C12 | 421 | 139–249 | 163–173 | 189–195 | 228–238 | 1–123 | 26–35 | 50–66 | 99–112 | SRDLLLFPTDSLLF (SEQ ID NO: 2622) |
| I086D01 | 422 | 139–249 | 163–173 | 189–195 | 228–238 | 1–123 | 26–35 | 50–66 | 99–112 | SRDLLLFPSAPLTP (SEQ ID NO: 2630) |

TABLE 1-continued scFvs that Immunospecifically Bind to BLyS

| Clone ID | scFv SEQ ID NO | AAs of VL | AAs of VL CDR1 | AAs of VL CDR2 | AAs of VL CDR3 | AAs of VH | AAs of VH CDR1 | AAs of VH CDR2 | AAs of VH CDR3 | VH CDR3 Sequence (SEQ ID NO) |
|---|---|---|---|---|---|---|---|---|---|---|
| I086D04 | 423 | 139–249 | 163–173 | 189–195 | 228–238 | 1–123 | 26–35 | 50–66 | 99–112 | SRYLLLFPYAPLYD (SEQ ID NO: 2697) |
| I086D05 | 424 | 139–249 | 163–173 | 189–195 | 228–238 | 1–123 | 26–35 | 50–66 | 99–112 | SRDLLLFPHSPLSF (SEQ ID NO: 2461) |
| I086D06 | 425 | 139–249 | 163–173 | 189–195 | 228–238 | 1–123 | 26–35 | 50–66 | 99–112 | SRDLLLFPTAPLDL (SEQ ID NO: 2379) |
| I086D07 | 426 | 139–249 | 163–173 | 189–195 | 228–238 | 1–123 | 26–35 | 50–66 | 99–112 | SRDLLLFPHTHLTF (SEQ ID NO: 2365) |
| I086D08 | 427 | 139–249 | 163–173 | 189–195 | 228–238 | 1–123 | 26–35 | 50–66 | 99–112 | SRDLLLFPHSSLDF (SEQ ID NO: 2473) |
| I086D09 | 428 | 139–249 | 163–173 | 189–195 | 228–238 | 1–123 | 26–35 | 50–66 | 99–112 | SRDLLLFPNHPMFP (SEQ ID NO: 2665) |
| I086D10 | 429 | 139–249 | 163–173 | 189–195 | 228–238 | 1–123 | 26–35 | 50–66 | 99–112 | SRDLLLFPLSSLEF (SEQ ID NO: 2587) |
| I086D11 | 430 | 139–249 | 163–173 | 189–195 | 228–238 | 1–123 | 26–35 | 50–66 | 99–112 | SRDLLLFPNAPLHP (SEQ ID NO: 2610) |
| I086D12 | 431 | 139–249 | 163–173 | 189–195 | 228–238 | 1–123 | 26–35 | 50–66 | 99–112 | SRDLLLFPRAHLRF (SEQ ID NO: 2469) |
| I086E02 | 432 | 139–249 | 163–173 | 189–195 | 228–238 | 1–123 | 26–35 | 50–66 | 99–112 | SRDLLLFPYDPLHF (SEQ ID NO: 2621) |
| I086E03 | 433 | 139–249 | 163–173 | 189–195 | 228–238 | 1–123 | 26–35 | 50–66 | 99–112 | SRDLLLFPHDALQS (SEQ ID NO: 2598) |
| I086E05 | 434 | 139–249 | 163–173 | 189–195 | 228–238 | 1–123 | 26–35 | 50–66 | 99–112 | SRDLLLFPRTPLTF (SEQ ID NO: 2567) |
| I086E07 | 435 | 139–249 | 163–173 | 189–195 | 228–238 | 1–123 | 26–35 | 50–66 | 99–112 | SRDLLLFPAAHLSF (SEQ ID NO: 2398) |
| I086E08 | 436 | 139–249 | 163–173 | 189–195 | 228–238 | 1–123 | 26–35 | 50–66 | 99–112 | SRDLLLFPRAPLLF (SEQ ID NO: 2490) |
| I086E09 | 437 | 139–249 | 163–173 | 189–195 | 228–238 | 1–123 | 26–35 | 50–66 | 99–112 | SRDLLLFPFSPLAP (SEQ ID NO: 2464) |
| I086E10 | 438 | 139–249 | 163–173 | 189–195 | 228–238 | 1–123 | 26–35 | 50–66 | 99–112 | SRDLLLFPRAPLDF (SEQ ID NO: 2367) |
| I086E12 | 439 | 139–249 | 163–173 | 189–195 | 228–238 | 1–123 | 26–35 | 50–66 | 99–112 | SRDLLLFPTAPLRF (SEQ ID NO: 2522) |
| I086F02 | 440 | 139–249 | 163–173 | 189–195 | 228–238 | 1–123 | 26–35 | 50–66 | 99–112 | SRDLLLFPSSPLRI (SEQ ID NO: 2714) |
| I086F05 | 441 | 139–249 | 163–173 | 189–195 | 228–238 | 1–123 | 26–35 | 50–66 | 99–112 | SRDLLLFPTEPLQF (SEQ ID NO: 2540) |
| I086F08 | 442 | 139–249 | 163–173 | 189–195 | 228–238 | 1–123 | 26–35 | 50–66 | 99–112 | SRDLLLFPSDPLSA (SEQ ID NO: 2643) |
| I086F09 | 443 | 139–249 | 163–173 | 189–195 | 228–238 | 1–123 | 26–35 | 50–66 | 99–112 | SRDLLLFPYNPPIF (SEQ ID NO: 2653) |
| I086F11 | 444 | 139–249 | 163–173 | 189–195 | 228–238 | 1–123 | 26–35 | 50–66 | 99–112 | SRDLLLFPHTPLLF (SEQ ID NO: 2489) |
| I086G03 | 445 | 139–249 | 163–173 | 189–195 | 228–238 | 1–123 | 26–35 | 50–66 | 99–112 | SRDLLLFPHAPLDL (SEQ ID NO: 2513) |
| I086G04 | 446 | 139–249 | 163–173 | 189–195 | 228–238 | 1–123 | 26–35 | 50–66 | 99–112 | SRDLLLFPFDPLLI (SEQ ID NO: 2454) |
| I086G05 | 447 | 139–249 | 163–173 | 189–195 | 228–238 | 1–123 | 26–35 | 50–66 | 99–112 | SRDLLLFPTDALRI (SEQ ID NO: 2537) |
| I086G06 | 448 | 139–249 | 163–173 | 189–195 | 228–238 | 1–123 | 26–35 | 50–66 | 99–112 | SRDLLLFPAAPLTP (SEQ ID NO: 2407) |
| I086G07 | 449 | 139–249 | 163–173 | 189–195 | 228–238 | 1–123 | 26–35 | 50–66 | 99–112 | SRDLLLFPEGPLLF (SEQ ID NO: 2448) |
| I086G09 | 450 | 139–249 | 163–173 | 189–195 | 228–238 | 1–123 | 26–35 | 50–66 | 99–112 | SRDLLLFPYAPLSF (SEQ ID NO: 2385) |
| I086G10 | 451 | 139–249 | 163–173 | 189–195 | 228–238 | 1–123 | 26–35 | 50–66 | 99–112 | SRDLLLFPADSLSF (SEQ ID NO: 2391) |
| I086H05 | 452 | 139–249 | 163–173 | 189–195 | 228–238 | 1–123 | 26–35 | 50–66 | 99–112 | SRDLLLFPYSPLTH (SEQ ID NO: 2679) |
| I089A01 | 453 | 138–248 | 162–172 | 188–194 | 227–237 | 1–122 | 26–35 | 50–66 | 99–111 | SRDLLLFPHDPLI (SEQ ID NO: 2612) |
| I089A03 | 454 | 139–249 | 163–173 | 189–195 | 228–238 | 1–123 | 26–35 | 50–66 | 99–112 | SRDLLLFPLTPLLI (SEQ ID NO: 2590) |
| I089A06 | 455 | 139–249 | 163–173 | 189–195 | 228–238 | 1–123 | 26–35 | 50–66 | 99–112 | SRDLLLFPHTPLHF (SEQ ID NO: 2485) |
| I089A07 | 456 | 139–249 | 163–173 | 189–195 | 228–238 | 1–123 | 26–35 | 50–66 | 99–112 | SRDLLLFPTDALYF (SEQ ID NO: 2539) |
| I089A08 | 457 | 139–249 | 163–173 | 189–195 | 228–238 | 1–123 | 26–35 | 50–66 | 99–112 | SRDLLLFPYTPLLF (SEQ ID NO: 2682) |
| I089A10 | 458 | 139–249 | 163–173 | 189–195 | 228–238 | 1–123 | 26–35 | 50–66 | 99–112 | SRDLLLFPHQPLTF (SEQ ID NO: 2436) |
| I089A11 | 459 | 139–249 | 163–173 | 189–195 | 228–238 | 1–123 | 26–35 | 50–66 | 99–112 | SRDLLLFPRTYLDF (SEQ ID NO: 2572) |
| I089B01 | 460 | 139–249 | 163–173 | 189–195 | 228–238 | 1–123 | 26–35 | 50–66 | 99–112 | SRDLLLFPHSPLHS (SEQ ID NO: 2450) |
| I089B02 | 461 | 139–249 | 163–173 | 189–195 | 228–238 | 1–123 | 26–35 | 50–66 | 99–112 | SRDLLLFPHHSFDL (SEQ ID NO: 2147) |
| I089B03 | 462 | 139–249 | 163–173 | 189–195 | 228–238 | 1–123 | 26–35 | 50–66 | 99–112 | SRDLLLFPTSPLQP (SEQ ID NO: 2528) |
| I089B04 | 463 | 139–249 | 163–173 | 189–195 | 228–238 | 1–123 | 26–35 | 50–66 | 99–112 | SRDLLLFPTHPLLF (SEQ ID NO: 2556) |
| I089B05 | 464 | 139–249 | 163–173 | 189–195 | 228–238 | 1–123 | 26–35 | 50–66 | 99–112 | SRDLLLFPSSPLIF (SEQ ID NO: 2712) |
| I089B06 | 465 | 139–249 | 163–173 | 189–195 | 228–238 | 1–123 | 26–35 | 50–66 | 99–112 | SRDLLLFPMAPLSP (SEQ ID NO: 2596) |
| I089B07 | 466 | 139–249 | 163–173 | 189–195 | 228–238 | 1–123 | 26–35 | 50–66 | 99–112 | SRDLLLFPYSGLDA (SEQ ID NO: 2374) |
| I089B08 | 467 | 139–249 | 163–173 | 189–195 | 228–238 | 1–123 | 26–35 | 50–66 | 99–112 | SRDLLLFPAAPLSP (SEQ ID NO: 2405) |
| I089B09 | 468 | 139–249 | 163–173 | 189–195 | 228–238 | 1–123 | 26–35 | 50–66 | 99–112 | SRDLLLFPKSPILF (SEQ ID NO: 2384) |
| I089B10 | 469 | 139–249 | 163–173 | 189–195 | 228–238 | 1–123 | 26–35 | 50–66 | 99–112 | SRDLLLFPTSPLFF (SEQ ID NO: 2571) |

TABLE 1-continued scFvs that Immunospecifically Bind to BLyS

| Clone ID | scFv SEQ ID NO | AAs of VL | AAs of VL CDR1 | AAs of VL CDR2 | AAs of VL CDR3 | AAs of VH | AAs of VH CDR1 | AAs of VH CDR2 | AAs of VH CDR3 | VH CDR3 Sequence (SEQ ID NO) |
|---|---|---|---|---|---|---|---|---|---|---|
| I089B11 | 470 | 139–249 | 163–173 | 189–195 | 228–238 | 1–123 | 26–35 | 50–66 | 99–112 | SRDLLLFPNSPLFP (SEQ ID NO: 2388) |
| I089C01 | 471 | 139–249 | 163–173 | 189–195 | 228–238 | 1–123 | 26–35 | 50–66 | 99–112 | SRDLLLFPHYGMDV (SEQ ID NO: 2133) |
| I089C02 | 472 | 139–249 | 163–173 | 189–195 | 228–238 | 1–123 | 26–35 | 50–66 | 99–112 | SRDLLLFPRSPLLF (SEQ ID NO: 2551) |
| I089C03 | 473 | 139–249 | 163–173 | 189–195 | 228–238 | 1–123 | 26–35 | 50–66 | 99–112 | SRDLLLFPYHPLLF (SEQ ID NO: 2532) |
| I089C05 | 474 | 139–249 | 163–173 | 189–195 | 228–238 | 1–123 | 26–35 | 50–66 | 99–112 | SRDLLLFPSSALRF (SEQ ID NO: 2722) |
| I089C06 | 475 | 139–249 | 163–173 | 189–195 | 228–238 | 1–123 | 26–35 | 50–66 | 99–112 | SRDLLLFPSPYLSF (SEQ ID NO: 2701) |
| I089C07 | 476 | 139–249 | 163–173 | 189–195 | 228–238 | 1–123 | 26–35 | 50–66 | 99–112 | SRDLLLFPQAPLFD (SEQ ID NO: 2683) |
| I089C09 | 477 | 139–249 | 163–173 | 189–195 | 228–238 | 1–123 | 26–35 | 50–66 | 99–112 | SRDLLLFPHAPFTF (SEQ ID NO: 2507) |
| I089D01 | 478 | 139–249 | 163–173 | 189–195 | 228–238 | 1–123 | 26–35 | 50–66 | 99–112 | SRDLLLFPHAPLVL (SEQ ID NO: 2581) |
| I089D02 | 479 | 139–249 | 163–173 | 189–195 | 228–238 | 1–123 | 26–35 | 50–66 | 99–112 | SRDLLLFPHYGMDV (SEQ ID NO: 2133) |
| I089D03 | 480 | 139–249 | 163–173 | 189–195 | 228–238 | 1–123 | 26–35 | 50–66 | 99–112 | SRDLLLFPHYPLLF (SEQ ID NO: 2344) |
| I089D04 | 481 | 139–249 | 163–173 | 189–195 | 228–238 | 1–123 | 26–35 | 50–66 | 99–112 | SRDLLLFPSSPLSP (SEQ ID NO: 2717) |
| I089D05 | 482 | 139–249 | 163–173 | 189–195 | 228–238 | 1–123 | 26–35 | 50–66 | 99–112 | SRDLLLFPHAPLFT (SEQ ID NO: 2546) |
| I089D07 | 483 | 139–249 | 163–173 | 189–195 | 228–238 | 1–123 | 26–35 | 50–66 | 99–112 | SRDLLLFPNDPLLI (SEQ ID NO: 2634) |
| I089D08 | 484 | 138–248 | 162–172 | 188–194 | 227–237 | 1–122 | 26–35 | 50–66 | 99–111 | SRDLLLFPHAPLQ (SEQ ID NO: 2554) |
| I089D09 | 485 | 139–249 | 163–173 | 189–195 | 228–238 | 1–123 | 26–35 | 50–66 | 99–112 | SRDLLLFPSHAFHE (SEQ ID NO: 2677) |
| I089D11 | 486 | 139–249 | 163–173 | 189–195 | 228–238 | 1–123 | 26–35 | 50–66 | 99–112 | SRDLLLFPNHPLYP (SEQ ID NO: 2663) |
| I089E01 | 487 | 139–249 | 163–173 | 189–195 | 228–238 | 1–123 | 26–35 | 50–66 | 99–112 | SRDLLLFPYSPLFP (SEQ ID NO: 2657) |
| I089E02 | 488 | 139–249 | 163–173 | 189–195 | 228–238 | 1–123 | 26–35 | 50–66 | 99–112 | SRDLLLFPQDPLHP (SEQ ID NO: 2346) |
| I089E03 | 489 | 139–249 | 163–173 | 189–195 | 228–238 | 1–123 | 26–35 | 50–66 | 99–112 | SRDLLLFPDAPLFP (SEQ ID NO: 2423) |
| I089E04 | 490 | 139–249 | 163–173 | 189–195 | 228–238 | 1–123 | 26–35 | 50–66 | 99–112 | SRDLLLFPHSPLLI (SEQ ID NO: 2453) |
| I089E06 | 491 | 139–249 | 163–173 | 189–195 | 228–238 | 1–123 | 26–35 | 50–66 | 99–112 | SRDLLLFPGSPLLF (SEQ ID NO: 2491) |
| I089E09 | 492 | 139–249 | 163–173 | 189–195 | 228–238 | 1–123 | 26–35 | 50–66 | 99–112 | SRDLLLFPSSPLTF (SEQ ID NO: 2718) |
| I089E10 | 493 | 139–249 | 163–173 | 189–195 | 228–238 | 1–123 | 26–35 | 50–66 | 99–112 | SRDLLLFPTQPLSF (SEQ ID NO: 2566) |
| I089E11 | 494 | 139–249 | 163–173 | 189–195 | 228–238 | 1–123 | 26–35 | 50–66 | 99–112 | SRDLLLFPLSPLWP (SEQ ID NO: 2578) |
| I089F01 | 495 | 139–249 | 163–173 | 189–195 | 228–238 | 1–123 | 26–35 | 50–66 | 99–112 | SRDLLLFPTFPLLF (SEQ ID NO: 2380) |
| I089F03 | 496 | 139–249 | 163–173 | 189–195 | 228–238 | 1–123 | 26–35 | 50–66 | 99–112 | SRDLLLFPHDPLLL (SEQ ID NO: 2580) |
| I089F04 | 497 | 139–249 | 163–173 | 189–195 | 228–238 | 1–123 | 26–35 | 50–66 | 99–112 | SRDLLLFPYSPLLF (SEQ ID NO: 2670) |
| I089F05 | 498 | 139–249 | 163–173 | 189–195 | 228–238 | 1–123 | 26–35 | 50–66 | 99–112 | SRDLLLFPHSPLRI (SEQ ID NO: 2459) |
| I089F06 | 499 | 139–249 | 163–173 | 189–195 | 228–238 | 1–123 | 26–35 | 50–66 | 99–112 | SRDLLLFPRAPLLF (SEQ ID NO: 2490) |
| I089F08 | 500 | 139–249 | 163–173 | 189–195 | 228–238 | 1–123 | 26–35 | 50–66 | 99–112 | SRDLLLFPRTPLTF (SEQ ID NO: 2567) |
| I089F09 | 501 | 139–249 | 163–173 | 189–195 | 228–238 | 1–123 | 26–35 | 50–66 | 99–112 | SRDLLLFPLAPLSF (SEQ ID NO: 2555) |
| I089F10 | 502 | 139–249 | 163–173 | 189–195 | 228–238 | 1–123 | 26–35 | 50–66 | 99–112 | SRDLLLFPNQPLSF (SEQ ID NO: 2667) |
| I089F11 | 503 | 139–249 | 163–173 | 189–195 | 228–238 | 1–123 | 26–35 | 50–66 | 99–112 | SRDLLLFPLEPMHF (SEQ ID NO: 2565) |
| I089G01 | 504 | 139–249 | 163–173 | 189–195 | 228–238 | 1–123 | 26–35 | 50–66 | 99–112 | SRDLLLFPSAPLTF (SEQ ID NO: 2626) |
| I089G02 | 505 | 139–249 | 163–173 | 189–195 | 228–238 | 1–123 | 26–35 | 50–66 | 99–112 | SRDLLLFPSHPLLF (SEQ ID NO: 2687) |
| I089G03 | 506 | 139–249 | 163–173 | 189–195 | 228–238 | 1–123 | 26–35 | 50–66 | 99–112 | SRDLLLFPRTPLVF (SEQ ID NO: 2721) |
| I089G05 | 507 | 139–249 | 163–173 | 189–195 | 228–238 | 1–123 | 26–35 | 50–66 | 99–112 | SRDLLLFPGSPLTF (SEQ ID NO: 2389) |
| I089G06 | 508 | 139–249 | 163–173 | 189–195 | 228–238 | 1–123 | 26–35 | 50–66 | 99–112 | SRDLLLFPTAPLLF (SEQ ID NO: 2514) |
| I089G07 | 509 | 139–249 | 163–173 | 189–195 | 228–238 | 1–123 | 26–35 | 50–66 | 99–112 | SRDLLLFPSAPLDF (SEQ ID NO: 2597) |
| I089G08 | 510 | 139–249 | 163–173 | 189–195 | 228–238 | 1–123 | 26–35 | 50–66 | 99–112 | SRDLLLFPSHPLSF (SEQ ID NO: 2688) |
| I089G11 | 511 | 139–249 | 163–173 | 189–195 | 228–238 | 1–123 | 26–35 | 50–66 | 99–112 | SRDLLLFPSFPLLF (SEQ ID NO: 2671) |
| I089H10 | 512 | 142–249 | 163–173 | 189–195 | 228–238 | 1–126 | 26–35 | 50–66 | 99–115 | DGYYDILTGYSYYGMDV (SEQ ID NO: 2135) |
| I090A02 | 513 | 139–249 | 163–173 | 189–195 | 228–238 | 1–123 | 26–35 | 50–66 | 99–112 | SRDLLLFPAKPLLF (SEQ ID NO: 2416) |
| I090A03 | 514 | 139–249 | 163–173 | 189–195 | 228–238 | 1–123 | 26–35 | 50–66 | 99–112 | SRDLLLFPNSTLSF (SEQ ID NO: 2678) |
| I090A04 | 515 | 139–249 | 163–173 | 189–195 | 228–238 | 1–123 | 26–35 | 50–66 | 99–112 | SRDLLLFPDAPLTP (SEQ ID NO: 2426) |
| I090A05 | 516 | 139–249 | 163–173 | 189–195 | 228–238 | 1–123 | 26–35 | 50–66 | 99–112 | SRDLLLFPHEPLLI (SEQ ID NO: 2648) |

TABLE 1-continued scFvs that Immunospecifically Bind to BLyS

| Clone ID | scFv SEQ ID NO | AAs of VL | AAs of VL CDR1 | AAs of VL CDR2 | AAs of VL CDR3 | AAs of VH | AAs of VH CDR1 | AAs of VH CDR2 | AAs of VH CDR3 | VH CDR3 Sequence (SEQ ID NO) |
|---|---|---|---|---|---|---|---|---|---|---|
| I090A06 | 517 | 139–249 | 163–173 | 189–195 | 228–238 | 1–123 | 26–35 | 50–66 | 99–112 | SRDLLLFPTYPLSF (SEQ ID NO: 2600) |
| I090A07 | 518 | 139–249 | 163–173 | 189–195 | 228–238 | 1–123 | 26–35 | 50–66 | 99–112 | SRDLLLFPTEPLVL (SEQ ID NO: 2479) |
| I090A08 | 519 | 139–249 | 163–173 | 189–195 | 228–238 | 1–123 | 26–35 | 50–66 | 99–112 | SRDLLLFPTYPLHF (SEQ ID NO: 2584) |
| I090B01 | 520 | 139–249 | 163–173 | 189–195 | 228–238 | 1–123 | 26–35 | 50–66 | 99–112 | SRDLLLFPHDPLTF (SEQ ID NO: 2627) |
| I090B03 | 521 | 139–249 | 163–173 | 189–195 | 228–238 | 1–123 | 26–35 | 50–66 | 99–112 | SRDLLLFPQAPLTN (SEQ ID NO: 2705) |
| I090B04 | 522 | 139–249 | 163–173 | 189–195 | 228–238 | 1–123 | 26–35 | 50–66 | 99–112 | SRDLLLFPHAPLEA (SEQ ID NO: 2520) |
| I090B05 | 523 | 139–249 | 163–173 | 189–195 | 228–238 | 1–123 | 26–35 | 50–66 | 99–112 | SRDLLLFPDHPLLF (SEQ ID NO: 2442) |
| I090B06 | 524 | 139–249 | 163–173 | 189–195 | 228–238 | 1–123 | 26–35 | 50–66 | 99–112 | SRDLLLFPRAPLSF (SEQ ID NO: 2496) |
| I090B08 | 525 | 139–249 | 163–173 | 189–195 | 228–238 | 1–123 | 26–35 | 50–66 | 99–112 | SRDLLLFPRGPLRF (SEQ ID NO: 2542) |
| I090B11 | 526 | 139–249 | 163–173 | 189–195 | 228–238 | 1–123 | 26–35 | 50–66 | 99–112 | SRDLLLFPFTPLTF (SEQ ID NO: 2474) |
| I090B12 | 527 | 139–249 | 163–173 | 189–195 | 228–238 | 1–123 | 26–35 | 50–66 | 99–112 | SRDLLLFPQHPLSP (SEQ ID NO: 2452) |
| I090C01 | 528 | 139–249 | 163–173 | 189–195 | 228–238 | 1–123 | 26–35 | 50–66 | 99–112 | SRDLLLFPSAPIVF (SEQ ID NO: 2591) |
| I090C02 | 529 | 139–249 | 163–173 | 189–195 | 228–238 | 1–123 | 26–35 | 50–66 | 99–112 | SRDLLLFPQAPLTF (SEQ ID NO: 2702) |
| I090C03 | 530 | 139–249 | 163–173 | 189–195 | 228–238 | 1–123 | 26–35 | 50–66 | 99–112 | SRDLLLFPRAPLRF (SEQ ID NO: 2493) |
| I090C05 | 531 | 139–249 | 163–173 | 189–195 | 228–238 | 1–123 | 26–35 | 50–66 | 99–112 | SRDLLLFPRTPLTF (SEQ ID NO: 2567) |
| I090C06 | 532 | 139–249 | 163–173 | 189–195 | 228–238 | 1–123 | 26–35 | 50–66 | 99–112 | SRDLLLFPHAPLDF (SEQ ID NO: 2538) |
| I090C07 | 533 | 139–249 | 163–173 | 189–195 | 228–238 | 1–123 | 26–35 | 50–66 | 99–112 | SRDLLLFPHAGFDS (SEQ ID NO: 2498) |
| I090C08 | 534 | 139–249 | 163–173 | 189–195 | 228–238 | 1–123 | 26–35 | 50–66 | 99–112 | SRDLLLFPYSPLSF (SEQ ID NO: 2676) |
| I090C10 | 535 | 139–249 | 163–173 | 189–195 | 228–238 | 1–123 | 26–35 | 50–66 | 99–112 | SRDLLLFPGRPLTF (SEQ ID NO: 2358) |
| I090D02 | 536 | 139–249 | 163–173 | 189–195 | 228–238 | 1–123 | 26–35 | 50–66 | 99–112 | SRDLLLFPAEHLLF (SEQ ID NO: 2408) |
| I090D03 | 537 | 139–249 | 163–173 | 189–195 | 228–238 | 1–123 | 26–35 | 50–66 | 99–112 | SRDLLLFPTAPLHP (SEQ ID NO: 2351) |
| I090D04 | 538 | 139–249 | 163–173 | 189–195 | 228–238 | 1–123 | 26–35 | 50–66 | 99–112 | SRDLLLFPHEPLTA (SEQ ID NO: 2654) |
| I090D05 | 539 | 139–249 | 163–173 | 189–195 | 228–238 | 1–123 | 26–35 | 50–66 | 99–112 | SRDLLLFPHAPLFE (SEQ ID NO: 2529) |
| I090D06 | 540 | 139–249 | 163–173 | 189–195 | 228–238 | 1–123 | 26–35 | 50–66 | 99–112 | SRDLLLFPRAPLDF (SEQ ID NO: 2367) |
| I090D07 | 541 | 139–249 | 163–173 | 189–195 | 228–238 | 1–123 | 26–35 | 50–66 | 99–112 | SRDLLLFPFGTLRF (SEQ ID NO: 2462) |
| I090D08 | 542 | 139–249 | 163–173 | 189–195 | 228–238 | 1–123 | 26–35 | 50–66 | 99–112 | SRDLLLFPSSPLVF (SEQ ID NO: 2723) |
| I090D09 | 543 | 139–249 | 163–173 | 189–195 | 228–238 | 1–123 | 26–35 | 50–66 | 99–112 | SRDLLLFPRDPLAF (SEQ ID NO: 2505) |
| I090D12 | 544 | 139–249 | 163–173 | 189–195 | 228–238 | 1–123 | 26–35 | 50–66 | 99–112 | SRDLLLFPTSPLSF (SEQ ID NO: 2579) |
| I090E04 | 545 | 139–249 | 163–173 | 189–195 | 228–238 | 1–123 | 26–35 | 50–66 | 99–112 | SRDLLLFPHAPLLL (SEQ ID NO: 2552) |
| I090E05 | 546 | 139–249 | 163–173 | 189–195 | 228–238 | 1–123 | 26–35 | 50–66 | 99–112 | SRDLLLFPSAPISF (SEQ ID NO: 2588) |
| I090E06 | 547 | 139–249 | 163–173 | 189–195 | 228–238 | 1–123 | 26–35 | 50–66 | 99–112 | SRDLLLFPQGPLSF (SEQ ID NO: 2443) |
| I090E07 | 548 | 139–249 | 163–173 | 189–195 | 228–238 | 1–123 | 26–35 | 50–66 | 99–112 | SRDLLLFPGSPLHP (SEQ ID NO: 2484) |
| I090E09 | 549 | 139–249 | 163–173 | 189–195 | 228–238 | 1–123 | 26–35 | 50–66 | 99–112 | SRDLLLFPSDPLSF (SEQ ID NO: 2647) |
| I090E11 | 550 | 139–249 | 163–173 | 189–195 | 228–238 | 1–123 | 26–35 | 50–66 | 99–112 | SRDLLLFPHDGLAP (SEQ ID NO: 2700) |
| I090E12 | 551 | 139–249 | 163–173 | 189–195 | 228–238 | 1–123 | 26–35 | 50–66 | 99–112 | SRDLLLFPTSPLTF (SEQ ID NO: 2582) |
| I090F01 | 552 | 139–249 | 163–173 | 189–195 | 228–238 | 1–123 | 26–35 | 50–66 | 99–112 | SRDLLLFPNGPLHP (SEQ ID NO: 2649) |
| I090F02 | 553 | 139–249 | 163–173 | 189–195 | 228–238 | 1–123 | 26–35 | 50–66 | 99–112 | SRDLLLFPQAPLSF (SEQ ID NO: 2696) |
| I090F03 | 554 | 139–249 | 163–173 | 189–195 | 228–238 | 1–123 | 26–35 | 50–66 | 99–112 | SRDLLLFPTAPLSF (SEQ ID NO: 2526) |
| I090F04 | 555 | 139–249 | 163–173 | 189–195 | 228–238 | 1–123 | 26–35 | 50–66 | 99–112 | SRDLLLFPFFPLQF (SEQ ID NO: 2460) |
| I090F05 | 556 | 139–249 | 163–173 | 189–195 | 228–238 | 1–123 | 26–35 | 50–66 | 99–112 | SRDLLLFPLDPLHF (SEQ ID NO: 2359) |
| I090F06 | 557 | 139–249 | 163–173 | 189–195 | 228–238 | 1–123 | 26–35 | 50–66 | 99–112 | SRDLLLFPSEPLQL (SEQ ID NO: 2666) |
| I090F07 | 558 | 139–249 | 163–173 | 189–195 | 228–238 | 1–123 | 26–35 | 50–66 | 99–112 | SRDLLLFPFAPLRF (SEQ ID NO: 2451) |
| I090F08 | 559 | 139–249 | 163–173 | 189–195 | 228–238 | 1–123 | 26–35 | 50–66 | 99–112 | SRDLLLFPLHPLIF (SEQ ID NO: 2570) |
| I090F09 | 560 | 139–249 | 163–173 | 189–195 | 228–238 | 1–123 | 26–35 | 50–66 | 99–112 | SRDLLLFPHYPLLF (SEQ ID NO: 2344) |
| I090F10 | 561 | 139–249 | 163–173 | 189–195 | 228–238 | 1–123 | 26–35 | 50–66 | 99–112 | SRDLLLFPRDPLRI (SEQ ID NO: 2527) |
| I090F11 | 562 | 139–249 | 163–173 | 189–195 | 228–238 | 1–123 | 26–35 | 50–66 | 99–112 | SRDLLLFPSNPLTF (SEQ ID NO: 2698) |
| I090G01 | 563 | 139–249 | 163–173 | 189–195 | 228–238 | 1–123 | 26–35 | 50–66 | 99–112 | SRDLLLFPTAPLEI (SEQ ID NO: 2347) |

TABLE 1-continued scFvs that Immunospecifically Bind to BLyS

| Clone ID | scFv SEQ ID NO | AAs of VL | AAs of VL CDR1 | AAs of VL CDR2 | AAs of VL CDR3 | AAs of VH | AAs of VH CDR1 | AAs of VH CDR2 | AAs of VH CDR3 | VH CDR3 Sequence (SEQ ID NO) |
|---|---|---|---|---|---|---|---|---|---|---|
| I090G02 | 564 | 139–249 | 163–173 | 189–195 | 228–238 | 1–123 | 26–35 | 50–66 | 99–112 | SRDLLLFPRDPLQF (SEQ ID NO: 2395) |
| I090G04 | 565 | 139–249 | 163–173 | 189–195 | 228–238 | 1–123 | 26–35 | 50–66 | 99–112 | SRDLLLFPHEPLAF (SEQ ID NO: 2633) |
| I090G05 | 566 | 139–249 | 163–173 | 189–195 | 228–238 | 1–123 | 26–35 | 50–66 | 99–112 | SRDLLLFPRAPLAF (SEQ ID NO: 2472) |
| I090G06 | 567 | 139–249 | 163–173 | 189–195 | 228–238 | 1–123 | 26–35 | 50–66 | 99–112 | SRDLLLFPYSPLAF (SEQ ID NO: 2656) |
| I090G07 | 568 | 139–249 | 163–173 | 189–195 | 228–238 | 1–123 | 26–35 | 50–66 | 99–112 | SRDLLLFPHTPLDS (SEQ ID NO: 2480) |
| I090G08 | 569 | 139–249 | 163–173 | 189–195 | 228–238 | 1–123 | 26–35 | 50–66 | 99–112 | SRDLLLFPHTPLTF (SEQ ID NO: 2492) |
| I090G09 | 570 | 139–249 | 163–173 | 189–195 | 228–238 | 1–123 | 26–35 | 50–66 | 99–112 | SRDLLLFPSEPLRI (SEQ ID NO: 2356) |
| I090G10 | 571 | 139–249 | 163–173 | 189–195 | 228–238 | 1–123 | 26–35 | 50–66 | 99–112 | SRDLLLFPTAPLDF (SEQ ID NO: 2343) |
| I090G12 | 572 | 139–249 | 163–173 | 189–195 | 228–238 | 1–123 | 26–35 | 50–66 | 99–112 | SRDLLLFPNRGLDL (SEQ ID NO: 2669) |
| I091A02 | 573 | 139–249 | 163–173 | 189–195 | 228–238 | 1–123 | 26–35 | 50–66 | 99–112 | SRDLLLFPYDPLFM (SEQ ID NO: 2724) |
| I091A03 | 574 | 139–249 | 163–173 | 189–195 | 228–238 | 1–123 | 26–35 | 50–66 | 99–112 | SRDLLLFPHAPLYP (SEQ ID NO: 2592) |
| I091A06 | 575 | 139–249 | 163–173 | 189–195 | 228–238 | 1–123 | 26–35 | 50–66 | 99–112 | SRDLLLFPSAPLAF (SEQ ID NO: 2594) |
| I091A11 | 576 | 139–249 | 163–173 | 189–195 | 228–238 | 1–123 | 26–35 | 50–66 | 99–112 | SRDLLLFPHSPITF (SEQ ID NO: 2441) |
| I091B01 | 577 | 139–249 | 163–173 | 189–195 | 228–238 | 1–123 | 26–35 | 50–66 | 99–112 | SRDLLLFPRYPLFF (SEQ ID NO: 2585) |
| I091B02 | 578 | 139–249 | 163–173 | 189–195 | 228–238 | 1–123 | 26–35 | 50–66 | 99–112 | SRDLLLFPYAPLDF (SEQ ID NO: 2361) |
| I091B04 | 579 | 139–249 | 163–173 | 189–195 | 228–238 | 1–123 | 26–35 | 50–66 | 99–112 | SRDLLLFPRDPLQF (SEQ ID NO: 2395) |
| I091B05 | 580 | 139–249 | 163–173 | 189–195 | 228–238 | 1–123 | 26–35 | 50–66 | 99–112 | SRDLLLFPHAPLEL (SEQ ID NO: 2475) |
| I091B07 | 581 | 139–249 | 163–173 | 189–195 | 228–238 | 1–123 | 26–35 | 50–66 | 99–112 | SRDLLLFPSAPLTF (SEQ ID NO: 2626) |
| I091B10 | 582 | 139–249 | 163–173 | 189–195 | 228–238 | 1–123 | 26–35 | 50–66 | 99–112 | SRDLLLFPTAPLAF (SEQ ID NO: 2342) |
| I091B11 | 583 | 139–249 | 163–173 | 189–195 | 228–238 | 1–123 | 26–35 | 50–66 | 99–112 | SRDLLLFPHSPLDF (SEQ ID NO: 2444) |
| I091B12 | 584 | 139–249 | 163–173 | 189–195 | 228–238 | 1–123 | 26–35 | 50–66 | 99–112 | SRDLLLFPSHPLTF (SEQ ID NO: 2690) |
| I091C02 | 585 | 139–249 | 163–173 | 189–195 | 228–238 | 1–123 | 26–35 | 50–66 | 99–112 | SRDLLLFPAHPLVI (SEQ ID NO: 2414) |
| I091C03 | 586 | 139–249 | 163–173 | 189–195 | 228–238 | 1–123 | 26–35 | 50–66 | 99–112 | SRDLLLFPQAPLYP (SEQ ID NO: 2378) |
| I091C04 | 587 | 139–249 | 163–173 | 189–195 | 228–238 | 1–123 | 26–35 | 50–66 | 99–112 | SRDLLLFPTAPLTF (SEQ ID NO: 2531) |
| I091C05 | 588 | 139–249 | 163–173 | 189–195 | 228–238 | 1–123 | 26–35 | 50–66 | 99–112 | SRDLLLFPTTPLHF (SEQ ID NO: 2583) |
| I091C06 | 589 | 139–249 | 163–173 | 189–195 | 228–238 | 1–123 | 26–35 | 50–66 | 99–112 | SRDLLLFPHYPLLF (SEQ ID NO: 2344) |
| I091C09 | 590 | 139–249 | 163–173 | 189–195 | 228–238 | 1–123 | 26–35 | 50–66 | 99–112 | SRDLLLFPHHPLSF (SEQ ID NO: 2415) |
| I091C11 | 591 | 139–249 | 163–173 | 189–195 | 228–238 | 1–123 | 26–35 | 50–66 | 99–112 | SRDLLLFPYHSYDI (SEQ ID NO: 2650) |
| I091C12 | 592 | 139–249 | 163–173 | 189–195 | 228–238 | 1–123 | 26–35 | 50–66 | 99–112 | SRDLLLFPYATLSF (SEQ ID NO: 2618) |
| I091D01 | 593 | 139–249 | 163–173 | 189–195 | 228–238 | 1–123 | 26–35 | 50–66 | 99–112 | SRDLLLFPNSPLAP (SEQ ID NO: 2672) |
| I091D02 | 594 | 139–249 | 163–173 | 189–195 | 228–238 | 1–123 | 26–35 | 50–66 | 99–112 | SRDLLLFPYSPLQP (SEQ ID NO: 2673) |
| I091D04 | 595 | 139–249 | 163–173 | 189–195 | 228–238 | 1–123 | 26–35 | 50–66 | 99–112 | SRDLLLFPQGPLSF (SEQ ID NO: 2443) |
| I091D05 | 596 | 139–249 | 163–173 | 189–195 | 228–238 | 1–123 | 26–35 | 50–66 | 99–112 | SRDLLLFPHDPLAP (SEQ ID NO: 2606) |
| I091D06 | 597 | 138–248 | 162–172 | 188–194 | 227–237 | 1–122 | 26–35 | 50–66 | 99–111 | SRDLLLFPHSPLL (SEQ ID NO: 2456) |
| I091D07 | 598 | 139–249 | 163–173 | 189–195 | 228–238 | 1–123 | 26–35 | 50–66 | 99–112 | SRDLLLFPNGALRF (SEQ ID NO: 2645) |
| I091D09 | 599 | 139–249 | 163–173 | 189–195 | 228–238 | 1–123 | 26–35 | 50–66 | 99–112 | SRDLLLFPYSPLRF (SEQ ID NO: 2719) |
| I091E01 | 600 | 139–249 | 163–173 | 189–195 | 228–238 | 1–123 | 26–35 | 50–66 | 99–112 | SRDLLLFPDAPLHP (SEQ ID NO: 2425) |
| I091E02 | 601 | 139–249 | 163–173 | 189–195 | 228–238 | 1–123 | 26–35 | 50–66 | 99–112 | SRDLLLFPQAPLFP (SEQ ID NO: 2689) |
| I091E03 | 602 | 139–249 | 163–173 | 189–195 | 228–238 | 1–123 | 26–35 | 50–66 | 99–112 | SRDLLLFPSAPLWP (SEQ ID NO: 2352) |
| I091E04 | 603 | 139–249 | 163–173 | 189–195 | 228–238 | 1–123 | 26–35 | 50–66 | 99–112 | SRDLLLFPKSPLAF (SEQ ID NO: 2547) |
| I091E06 | 604 | 139–249 | 163–173 | 189–195 | 228–238 | 1–123 | 26–35 | 50–66 | 99–112 | SRDLLLFPSSPLHP (SEQ ID NO: 2576) |
| I091E07 | 605 | 139–249 | 163–173 | 189–195 | 228–238 | 1–123 | 26–35 | 50–66 | 99–112 | SRDLLLFPNHPLTF (SEQ ID NO: 2661) |
| I091E08 | 606 | 139–249 | 163–173 | 189–195 | 228–238 | 1–123 | 26–35 | 50–66 | 99–112 | SRDLLLFPNAPLDS (SEQ ID NO: 2607) |
| I091E09 | 607 | 139–249 | 163–173 | 189–195 | 228–238 | 1–123 | 26–35 | 50–66 | 99–112 | SRDLLLFPYAPLDF (SEQ ID NO: 2361) |
| I091E10 | 608 | 139–249 | 163–173 | 189–195 | 228–238 | 1–123 | 26–35 | 50–66 | 99–112 | SRDLLLFPSSPLEF (SEQ ID NO: 2711) |
| I091F01 | 609 | 139–249 | 163–173 | 189–195 | 228–238 | 1–123 | 26–35 | 50–66 | 99–112 | SRDLLLFPRAPLFF (SEQ ID NO: 2486) |
| I091F03 | 610 | 139–249 | 163–173 | 189–195 | 228–238 | 1–123 | 26–35 | 50–66 | 99–112 | SRDLLLFPMAPLVG (SEQ ID NO: 2599) |

TABLE 1-continued scFvs that Immunospecifically Bind to BLyS

| Clone ID | scFv SEQ ID NO | AAs of VL | AAs of VL CDR1 | AAs of VL CDR2 | AAs of VL CDR3 | AAs of VH | AAs of VH CDR1 | AAs of VH CDR2 | AAs of VH CDR3 | VH CDR3 Sequence (SEQ ID NO) |
|---|---|---|---|---|---|---|---|---|---|---|
| I091F05 | 611 | 139–249 | 163–173 | 189–195 | 228–238 | 1–123 | 26–35 | 50–66 | 99–112 | SRDLLLFPLAPLHP (SEQ ID NO: 2553) |
| I091F06 | 612 | 139–249 | 163–173 | 189–195 | 228–238 | 1–123 | 26–35 | 50–66 | 99–112 | SRDLLLFPHDPLGF (SEQ ID NO: 2353) |
| I091F07 | 613 | 139–249 | 163–173 | 189–195 | 228–238 | 1–123 | 26–35 | 50–66 | 99–112 | SRDLLLFPHYGMDV (SEQ ID NO: 2133) |
| I091F08 | 614 | 139–249 | 163–173 | 189–195 | 228–238 | 1–123 | 26–35 | 50–66 | 99–112 | SRDLLLFPQSPLLF (SEQ ID NO: 2458) |
| I091F09 | 615 | 139–249 | 163–173 | 189–195 | 228–238 | 1–123 | 26–35 | 50–66 | 99–112 | SRDLLLFPHEHLSF (SEQ ID NO: 2354) |
| I091F10 | 616 | 139–249 | 163–173 | 189–195 | 228–238 | 1–123 | 26–35 | 50–66 | 99–112 | SRDLLLFPHSPLDF (SEQ ID NO: 2444) |
| I091F11 | 617 | 139–249 | 163–173 | 189–195 | 228–238 | 1–123 | 26–35 | 50–66 | 99–112 | SRDLLLFPHSPLSP (SEQ ID NO: 2549) |
| I091F12 | 618 | 139–249 | 163–173 | 189–195 | 228–238 | 1–123 | 26–35 | 50–66 | 99–112 | SRDLLLFPHYGMDV (SEQ ID NO: 2133) |
| I091G01 | 619 | 139–249 | 163–173 | 189–195 | 228–238 | 1–123 | 26–35 | 50–66 | 99–112 | SRDLLLFPNAALYP (SEQ ID NO: 2386) |
| I091G03 | 620 | 139–249 | 163–173 | 189–195 | 228–238 | 1–123 | 26–35 | 50–66 | 99–112 | SRDLLLFPNDPLFG (SEQ ID NO: 2355) |
| I091G04 | 621 | 139–249 | 163–173 | 189–195 | 228–238 | 1–123 | 26–35 | 50–66 | 99–112 | SRDLLLFPGAPLSP (SEQ ID NO: 2478) |
| I091G05 | 622 | 139–249 | 163–173 | 189–195 | 228–238 | 1–123 | 26–35 | 50–66 | 99–112 | ARDLLLFPAAPLWP (SEQ ID NO: 2397) |
| I091G06 | 623 | 138–248 | 162–172 | 188–194 | 227–237 | 1–122 | 26–35 | 50–66 | 99–111 | SRDLLLFPNDPLR (SEQ ID NO: 2637) |
| I091G07 | 624 | 139–249 | 163–173 | 189–195 | 228–238 | 1–123 | 26–35 | 50–66 | 99–112 | SRDLLLFPTAPLDP (SEQ ID NO: 2345) |
| I091G09 | 625 | 139–249 | 163–173 | 189–195 | 228–238 | 1–123 | 26–35 | 50–66 | 99–112 | SRDLLLFPTAPLFP (SEQ ID NO: 2349) |
| I091G10 | 626 | 139–249 | 163–173 | 189–195 | 228–238 | 1–123 | 26–35 | 50–66 | 99–112 | SRDLLLFPSDPLVF (SEQ ID NO: 2660) |
| I091G11 | 627 | 139–249 | 163–173 | 189–195 | 228–238 | 1–123 | 26–35 | 50–66 | 99–112 | SRDLLLFPGSPLTF (SEQ ID NO: 2389) |
| I091G12 | 628 | 139–249 | 163–173 | 189–195 | 228–238 | 1–123 | 26–35 | 50–66 | 99–112 | SRDLLLFPYSHLEF (SEQ ID NO: 2655) |
| I104A01 | 629 | 139–249 | 163–173 | 189–195 | 228–238 | 1–123 | 26–35 | 50–66 | 99–112 | SRDLLLFPQSPLHP (SEQ ID NO: 2455) |
| I104A07 | 630 | 139–249 | 163–173 | 189–195 | 228–238 | 1–123 | 26–35 | 50–66 | 99–112 | SRDLLLFPQAPLFP (SEQ ID NO: 2689) |
| I104A08 | 631 | 139–249 | 163–173 | 189–195 | 228–238 | 1–123 | 26–35 | 50–66 | 99–112 | SRDLLLFPYAPLTF (SEQ ID NO: 2617) |
| I104A09 | 632 | 139–249 | 163–173 | 189–195 | 228–238 | 1–123 | 26–35 | 50–66 | 99–112 | SRDLLLFPQNPLHP (SEQ ID NO: 2506) |
| I104A10 | 633 | 139–249 | 163–173 | 189–195 | 228–238 | 1–123 | 26–35 | 50–66 | 99–112 | SRDLLLFPHEPLCF (SEQ ID NO: 2636) |
| I104A11 | 634 | 139–249 | 163–173 | 189–195 | 228–238 | 1–123 | 26–35 | 50–66 | 99–112 | SRDLLLFPSAPLSF (SEQ ID NO: 2611) |
| I104A12 | 635 | 139–249 | 163–173 | 189–195 | 228–238 | 1–123 | 26–35 | 50–66 | 99–112 | SRDLLLFPMAPLRF (SEQ ID NO: 2593) |
| I104B02 | 636 | 139–249 | 163–173 | 189–195 | 228–238 | 1–123 | 26–35 | 50–66 | 99–112 | SRDLLLFPRSPLSF (SEQ ID NO: 2557) |
| I104B04 | 637 | 139–249 | 163–173 | 189–195 | 228–238 | 1–123 | 26–35 | 50–66 | 99–112 | SRDLLLFPSAPLYP (SEQ ID NO: 2387) |
| I104B09 | 638 | 139–249 | 163–173 | 189–195 | 228–238 | 1–123 | 26–35 | 50–66 | 99–112 | SRDLLLFPRDPLQF (SEQ ID NO: 2395) |
| I104B11 | 639 | 139–249 | 163–173 | 189–195 | 228–238 | 1–123 | 26–35 | 50–66 | 99–112 | SRDLLLFPTAPLTF (SEQ ID NO: 2531) |
| I104C01 | 640 | 139–249 | 163–173 | 189–195 | 228–238 | 1–123 | 26–35 | 50–66 | 99–112 | SRDLLLFPYSPLYP (SEQ ID NO: 2710) |
| I104C04 | 641 | 139–249 | 163–173 | 189–195 | 228–238 | 1–123 | 26–35 | 50–66 | 99–112 | SRDLLLFPASPLIF (SEQ ID NO: 2417) |
| I104C05 | 642 | 139–249 | 163–173 | 189–195 | 228–238 | 1–123 | 26–35 | 50–66 | 99–112 | SRDLLLFPRHPLLF (SEQ ID NO: 2543) |
| I104C06 | 643 | 138–248 | 162–172 | 188–194 | 227–237 | 1–122 | 26–35 | 50–66 | 99–111 | SRDLLLFPHAPLE (SEQ ID NO: 2524) |
| I104C07 | 644 | 139–249 | 163–173 | 189–195 | 228–238 | 1–123 | 26–35 | 50–66 | 99–112 | SRDLLLFPHAPLHP (SEQ ID NO: 2370) |
| I104C09 | 645 | 139–249 | 163–173 | 189–195 | 228–238 | 1–123 | 26–35 | 50–66 | 99–112 | SRDLLLFPHFPLIF (SEQ ID NO: 2399) |
| I104C11 | 646 | 139–249 | 163–173 | 189–195 | 228–238 | 1–123 | 26–35 | 50–66 | 99–112 | SRDLLLFPHEPLIF (SEQ ID NO: 2644) |
| I104D01 | 647 | 139–249 | 163–173 | 189–195 | 228–238 | 1–123 | 26–35 | 50–66 | 99–112 | SRDLLLFPNHAFDL (SEQ ID NO: 2652) |
| I104D02 | 648 | 139–249 | 163–173 | 189–195 | 228–238 | 1–123 | 26–35 | 50–66 | 99–112 | SRDLLLFPHTILYP (SEQ ID NO: 2497) |
| I104D03 | 649 | 139–249 | 163–173 | 189–195 | 228–238 | 1–123 | 26–35 | 50–66 | 99–112 | SRDLLLFPDWPLYP (SEQ ID NO: 2483) |
| I104D04 | 650 | 139–249 | 163–173 | 189–195 | 228–238 | 1–123 | 26–35 | 50–66 | 99–112 | SRDLLLFPHYPLFL (SEQ ID NO: 2511) |
| I104D07 | 651 | 139–249 | 163–173 | 189–195 | 228–238 | 1–123 | 26–35 | 50–66 | 99–112 | SRDLLLFPQAPLHP (SEQ ID NO: 2691) |
| I104D08 | 652 | 139–249 | 163–173 | 189–195 | 228–238 | 1–123 | 26–35 | 50–66 | 99–112 | SRDLLLFPHAPMDP (SEQ ID NO: 2595) |
| I104D09 | 653 | 139–249 | 163–173 | 189–195 | 228–238 | 1–123 | 26–35 | 50–66 | 99–112 | SRDLLLFPRAPLTF (SEQ ID NO: 2500) |
| I104E01 | 654 | 139–249 | 163–173 | 189–195 | 228–238 | 1–123 | 26–35 | 50–66 | 99–112 | SRDLLLFPRATLEF (SEQ ID NO: 2502) |
| I104E02 | 655 | 139–249 | 163–173 | 189–195 | 228–238 | 1–123 | 26–35 | 50–66 | 99–112 | SRDLLLFPHSPLFP (SEQ ID NO: 2447) |
| I104E03 | 656 | 139–249 | 163–173 | 189–195 | 228–238 | 1–123 | 26–35 | 50–66 | 99–112 | SRDLLLFPNDPLVL (SEQ ID NO: 2641) |
| I104E05 | 657 | 139–249 | 163–173 | 189–195 | 228–238 | 1–123 | 26–35 | 50–66 | 99–112 | SRDLLLFPHDPLYI (SEQ ID NO: 2463) |

TABLE 1-continued scFvs that Immunospecifically Bind to BLyS

| Clone ID | scFv SEQ ID NO | AAs of VL | AAs of VL CDR1 | AAs of VL CDR2 | AAs of VL CDR3 | AAs of VH | AAs of VH CDR1 | AAs of VH CDR2 | AAs of VH CDR3 | VH CDR3 Sequence (SEQ ID NO) |
|---|---|---|---|---|---|---|---|---|---|---|
| I104E11 | 658 | 139–249 | 163–173 | 189–195 | 228–238 | 1–123 | 26–35 | 50–66 | 99–112 | SRDLLLFPYAPLSF (SEQ ID NO: 2385) |
| I104E12 | 659 | 139–249 | 163–173 | 189–195 | 228–238 | 1–123 | 26–35 | 50–66 | 99–112 | SRDLLLFPASPLNP (SEQ ID NO: 2364) |
| I104F02 | 660 | 139–249 | 163–173 | 189–195 | 228–238 | 1–123 | 26–35 | 50–66 | 99–112 | SRDLLLFPHDPLSP (SEQ ID NO: 2616) |
| I104F03 | 661 | 139–249 | 163–173 | 189–195 | 228–238 | 1–123 | 26–35 | 50–66 | 99–112 | SRDLLLFPRDPLRF (SEQ ID NO: 2360) |
| I104F04 | 662 | 139–249 | 163–173 | 189–195 | 228–238 | 1–123 | 26–35 | 50–66 | 99–112 | SRDLLLFPGDPLDF (SEQ ID NO: 2481) |
| I104F05 | 663 | 139–249 | 163–173 | 189–195 | 228–238 | 1–123 | 26–35 | 50–66 | 99–112 | SRDLLLFPHGPLTF (SEQ ID NO: 2402) |
| I104F06 | 664 | 139–249 | 163–173 | 189–195 | 228–238 | 1–123 | 26–35 | 50–66 | 99–112 | SRDLLLFPHAPLSP (SEQ ID NO: 2573) |
| I104F07 | 665 | 139–249 | 163–173 | 189–195 | 228–238 | 1–123 | 26–35 | 50–66 | 99–112 | SRDLLLFPSSPLIL (SEQ ID NO: 2465) |
| I104F10 | 666 | 139–249 | 163–173 | 189–195 | 228–238 | 1–123 | 26–35 | 50–66 | 99–112 | SRDLLLFPNSPLSP (SEQ ID NO: 2362) |
| I104F11 | 667 | 139–249 | 163–173 | 189–195 | 228–238 | 1–123 | 26–35 | 50–66 | 99–112 | SRDLLLFPQDPLVF (SEQ ID NO: 2708) |
| I104F12 | 668 | 139–249 | 163–173 | 189–195 | 228–238 | 1–123 | 26–35 | 50–66 | 99–112 | SRDLLLFPKAPLVF (SEQ ID NO: 2544) |
| I104G04 | 669 | 139–249 | 163–173 | 189–195 | 228–238 | 1–123 | 26–35 | 50–66 | 99–112 | SRDLLLFPHAPLRF (SEQ ID NO: 2559) |
| I104G05 | 670 | 139–249 | 163–173 | 189–195 | 228–238 | 1–123 | 26–35 | 50–66 | 99–112 | SRDLLLFPRAPLAP (SEQ ID NO: 2476) |
| I104G09 | 671 | 139–249 | 163–173 | 189–195 | 228–238 | 1–123 | 26–35 | 50–66 | 99–112 | SRDLLLFPTAPLNF (SEQ ID NO: 2518) |
| I104G11 | 672 | 139–249 | 163–173 | 189–195 | 228–238 | 1–123 | 26–35 | 50–66 | 99–112 | SRHLLLFPQGPLSF (SEQ ID NO: 2482) |
| I105A02 | 673 | 139–249 | 163–173 | 189–195 | 228–238 | 1–123 | 26–35 | 50–66 | 99–112 | SRDLLLFPHLPLNP (SEQ ID NO: 2494) |
| I105A03 | 674 | 139–249 | 163–173 | 189–195 | 228–238 | 1–123 | 26–35 | 50–66 | 99–112 | SRDLLLFPHHSFDL (SEQ ID NO: 2147) |
| I105A04 | 675 | 139–249 | 163–173 | 189–195 | 228–238 | 1–123 | 26–35 | 50–66 | 99–112 | SRDLLLFPGAPLAP (SEQ ID NO: 2487) |
| I105A08 | 676 | 139–249 | 163–173 | 189–195 | 228–238 | 1–123 | 26–35 | 50–66 | 99–112 | SRDLLLFPQAPLYP (SEQ ID NO: 2378) |
| I105A09 | 677 | 139–249 | 163–173 | 189–195 | 228–238 | 1–123 | 26–35 | 50–66 | 99–112 | SRDLLLFPRSPLSF (SEQ ID NO: 2557) |
| I105A11 | 678 | 139–249 | 163–173 | 189–195 | 228–238 | 1–123 | 26–35 | 50–66 | 99–112 | SRDLLLFPSHSFDI (SEQ ID NO: 2692) |
| I105B04 | 679 | 139–249 | 163–173 | 189–195 | 228–238 | 1–123 | 26–35 | 50–66 | 99–112 | SRDLLLFPYSPLHP (SEQ ID NO: 2658) |
| I105B05 | 680 | 139–249 | 163–173 | 189–195 | 228–238 | 1–123 | 26–35 | 50–66 | 99–112 | SRDLLLFPYSPLSF (SEQ ID NO: 2676) |
| I105B07 | 681 | 139–249 | 163–173 | 189–195 | 228–238 | 1–123 | 26–35 | 50–66 | 99–112 | SRDLLLFPHHSFDL (SEQ ID NO: 2147) |
| I105B08 | 682 | 139–249 | 163–173 | 189–195 | 228–238 | 1–123 | 26–35 | 50–66 | 99–112 | SRDLLLFPHHSFDL (SEQ ID NO: 2147) |
| I105B10 | 683 | 139–249 | 163–173 | 189–195 | 228–238 | 1–123 | 26–35 | 50–66 | 99–112 | SRDLLLFPASPLNP (SEQ ID NO: 2364) |
| I105B11 | 684 | 139–249 | 163–173 | 189–195 | 228–238 | 1–123 | 26–35 | 50–66 | 99–112 | SRDLLLFPHEPLSP (SEQ ID NO: 2651) |
| I105B12 | 685 | 139–249 | 163–173 | 189–195 | 228–238 | 1–123 | 26–35 | 50–66 | 99–112 | SRDLLLFPLDPLII (SEQ ID NO: 2560) |
| I105C02 | 686 | 139–249 | 163–173 | 189–195 | 228–238 | 1–123 | 26–35 | 50–66 | 99–112 | SRDLLLFPRAPLAF (SEQ ID NO: 2472) |
| I105C03 | 687 | 139–249 | 163–173 | 189–195 | 228–238 | 1–123 | 26–35 | 50–66 | 99–112 | SRDLLLFPSSPLSF (SEQ ID NO: 2715) |
| I105C05 | 688 | 139–249 | 163–173 | 189–195 | 228–238 | 1–123 | 26–35 | 50–66 | 99–112 | SRDLLLFPHYGMDV (SEQ ID NO: 2133) |
| I105C06 | 689 | 139–249 | 163–173 | 189–195 | 228–238 | 1–123 | 26–35 | 50–66 | 99–112 | SRDLLLFPRAPLDF (SEQ ID NO: 2367) |
| I105C08 | 690 | 139–249 | 163–173 | 189–195 | 228–238 | 1–123 | 26–35 | 50–66 | 99–112 | SRDLLLFPRSPLTF (SEQ ID NO: 2562) |
| I105C12 | 691 | 139–249 | 163–173 | 189–195 | 228–238 | 1–123 | 26–35 | 50–66 | 99–112 | SRDLLLFPQHGFDA (SEQ ID NO: 2446) |
| I105D04 | 692 | 139–249 | 163–173 | 189–195 | 228–238 | 1–123 | 26–35 | 50–66 | 99–112 | SRDLLLFPRDPLRF (SEQ ID NO: 2360) |
| I105D06 | 693 | 139–249 | 163–173 | 189–195 | 228–238 | 1–123 | 26–35 | 50–66 | 99–112 | SRDLLLFPRDPLSF (SEQ ID NO: 2368) |
| I105D08 | 694 | 139–249 | 163–173 | 189–195 | 228–238 | 1–123 | 26–35 | 50–66 | 99–112 | SRDLLLFPYAPLAF (SEQ ID NO: 2608) |
| I105D09 | 695 | 139–249 | 163–173 | 189–195 | 228–238 | 1–123 | 26–35 | 50–66 | 99–112 | SRDLLLFPHAAFDV (SEQ ID NO: 2619) |
| I105D10 | 696 | 139–249 | 163–173 | 189–195 | 228–238 | 1–123 | 26–35 | 50–66 | 99–112 | SRDLLLFPHEPLFP (SEQ ID NO: 2640) |
| I105D11 | 697 | 139–249 | 163–173 | 189–195 | 228–238 | 1–123 | 26–35 | 50–66 | 99–112 | SRDLLLFPRSALTF (SEQ ID NO: 2519) |
| I105E01 | 698 | 139–249 | 163–173 | 189–195 | 228–238 | 1–123 | 26–35 | 50–66 | 99–112 | SRDLLLFPHHSFDS (SEQ ID NO: 2422) |
| I105E06 | 699 | 139–249 | 163–173 | 189–195 | 228–238 | 1–123 | 26–35 | 50–66 | 99–112 | SRDLLLFPHYGMDV (SEQ ID NO: 2133) |
| I105E11 | 700 | 139–249 | 163–173 | 189–195 | 228–238 | 1–123 | 26–35 | 50–66 | 99–112 | SRDLLLFPNSPLHP (SEQ ID NO: 2675) |
| I105F03 | 701 | 139–249 | 163–173 | 189–195 | 228–238 | 1–123 | 26–35 | 50–66 | 99–112 | SRDLLLFPHHPLDS (SEQ ID NO: 2409) |
| I105F06 | 702 | 139–249 | 163–173 | 189–195 | 228–238 | 1–123 | 26–35 | 50–66 | 99–112 | SRDLLLFPQAPLHP (SEQ ID NO: 2691) |
| I105F07 | 703 | 139–249 | 163–173 | 189–195 | 228–238 | 1–123 | 26–35 | 50–66 | 99–112 | SRDLLLFPSWPLTF (SEQ ID NO: 2340) |
| I105F09 | 704 | 139–249 | 163–173 | 189–195 | 228–238 | 1–123 | 26–35 | 50–66 | 99–112 | SRDLLLFPHYPLLF (SEQ ID NO: 2344) |

TABLE 1-continued scFvs that Immunospecifically Bind to BLyS

| Clone ID | scFv SEQ ID NO | AAs of VL | AAs of VL CDR1 | AAs of VL CDR2 | AAs of VL CDR3 | AAs of VH | AAs of VH CDR1 | AAs of VH CDR2 | AAs of VH CDR3 | VH CDR3 Sequence (SEQ ID NO) |
|---|---|---|---|---|---|---|---|---|---|---|
| I105F12 | 705 | 139–249 | 163–173 | 189–195 | 228–238 | 1–123 | 26–35 | 50–66 | 99–112 | SRDLLLFPTYPLVF (SEQ ID NO: 2604) |
| I105G03 | 706 | 139–249 | 163–173 | 189–195 | 228–238 | 1–123 | 26–35 | 50–66 | 99–112 | SRDLLLFPHAPLHP (SEQ ID NO: 2370) |
| I105G08 | 707 | 139–249 | 163–173 | 189–195 | 228–238 | 1–123 | 26–35 | 50–66 | 99–112 | SRDLLLFPKHPLVF (SEQ ID NO: 2366) |
| I105G09 | 708 | 139–249 | 163–173 | 189–195 | 228–238 | 1–123 | 26–35 | 50–66 | 99–112 | SRDLLLFPASPLNP (SEQ ID NO: 2364) |
| I105G10 | 709 | 139–249 | 163–173 | 189–195 | 228–238 | 1–123 | 26–35 | 50–66 | 99–112 | SRDLLLFPHHSFDA (SEQ ID NO: 2419) |
| I105G11 | 710 | 139–249 | 163–173 | 189–195 | 228–238 | 1–123 | 26–35 | 50–66 | 99–112 | SRDLLLFPHDPLLF (SEQ ID NO: 2614) |
| I107A01 | 711 | 139–249 | 163–173 | 189–195 | 228–238 | 1–123 | 26–35 | 50–66 | 99–112 | SRDLLLFPRHPLVF (SEQ ID NO: 2545) |
| I107A03 | 712 | 139–249 | 163–173 | 189–195 | 228–238 | 1–123 | 26–35 | 50–66 | 99–112 | SRDLLLFPRAPLYP (SEQ ID NO: 2501) |
| I107A06 | 713 | 139–249 | 163–173 | 189–195 | 228–238 | 1–123 | 26–35 | 50–66 | 99–112 | SRDLLLFPHAPLDP (SEQ ID NO: 2369) |
| I107A07 | 714 | 139–249 | 163–173 | 189–195 | 228–238 | 1–123 | 26–35 | 50–66 | 99–112 | SRDLLLFPNAPLSP (SEQ ID NO: 2371) |
| I107A09 | 715 | 139–249 | 163–173 | 189–195 | 228–238 | 1–123 | 26–35 | 50–66 | 99–112 | SRDLLLFPQAPLSP (SEQ ID NO: 2699) |
| I107A12 | 716 | 139–249 | 163–173 | 189–195 | 228–238 | 1–123 | 26–35 | 50–66 | 99–112 | SRDLLLFPHAPLSF (SEQ ID NO: 2564) |
| I107B02 | 717 | 139–249 | 163–173 | 189–195 | 228–238 | 1–123 | 26–35 | 50–66 | 99–112 | SRDLLLFPHAPLFP (SEQ ID NO: 2533) |
| I107B04 | 718 | 139–249 | 163–173 | 189–195 | 228–238 | 1–123 | 26–35 | 50–66 | 99–112 | SRDLLLFPASPLTF (SEQ ID NO: 2420) |
| I107B05 | 719 | 139–249 | 163–173 | 189–195 | 228–238 | 1–123 | 26–35 | 50–66 | 99–112 | SRDLLLFPHYGMDV (SEQ ID NO: 2133) |
| I107C01 | 720 | 137–247 | 161–171 | 187–193 | 226–236 | 1–121 | 24–33 | 48–64 | 97–110 | SRDLLLFPHYPLLF (SEQ ID NO: 2344) |
| I107C02 | 721 | 139–249 | 163–173 | 189–195 | 228–238 | 1–123 | 26–35 | 50–66 | 99–112 | SRDLLLFPHYGMYV (SEQ ID NO: 2504) |
| I107C04 | 722 | 139–249 | 163–173 | 189–195 | 228–238 | 1–123 | 26–35 | 50–66 | 99–112 | SRDLLLFPHYPLHP (SEQ ID NO: 2357) |
| I107C06 | 723 | 139–249 | 163–173 | 189–195 | 228–238 | 1–123 | 26–35 | 50–66 | 99–112 | SRDLLLFPHAPLAP (SEQ ID NO: 2510) |
| I107C08 | 724 | 139–249 | 163–173 | 189–195 | 228–238 | 1–123 | 26–35 | 50–66 | 99–112 | SRDLLLFPQAPLEP (SEQ ID NO: 2681) |
| I107C10 | 725 | 139–249 | 163–173 | 189–195 | 228–238 | 1–123 | 26–35 | 50–66 | 99–112 | SRDLLLFPSHAFDL (SEQ ID NO: 2674) |
| I107D01 | 726 | 139–249 | 163–173 | 189–195 | 228–238 | 1–123 | 26–35 | 50–66 | 99–112 | SRDLLLFPYAPLDF (SEQ ID NO: 2361) |
| I107D04 | 727 | 139–249 | 163–173 | 189–195 | 228–238 | 1–123 | 26–35 | 50–66 | 99–112 | SRDLLLFPNAPLSF (SEQ ID NO: 2625) |
| I107D07 | 728 | 139–249 | 163–173 | 189–195 | 228–238 | 1–123 | 26–35 | 50–66 | 99–112 | SRDLLLFPSHSFDV (SEQ ID NO: 2693) |
| I107D12 | 729 | 139–249 | 163–173 | 189–195 | 228–238 | 1–123 | 26–35 | 50–66 | 99–112 | SRDLLLFPHHSFDT (SEQ ID NO: 2424) |
| I107E01 | 730 | 139–249 | 163–173 | 189–195 | 228–238 | 1–123 | 26–35 | 50–66 | 99–112 | SRDLLLFPMLGLDL (SEQ ID NO: 2499) |
| I107E05 | 731 | 139–249 | 163–173 | 189–195 | 228–238 | 1–123 | 26–35 | 50–66 | 99–112 | SRDLLLFPRAPLDF (SEQ ID NO: 2367) |
| I107E07 | 732 | 139–249 | 163–173 | 189–195 | 228–238 | 1–123 | 26–35 | 50–66 | 99–112 | SRDLLLFPRSPLLF (SEQ ID NO: 2551) |
| I107E09 | 733 | 139–249 | 163–173 | 189–195 | 228–238 | 1–123 | 26–35 | 50–66 | 99–112 | SRDLLLFPKAPLTF (SEQ ID NO: 2382) |
| I107F01 | 734 | 139–249 | 163–173 | 189–195 | 228–238 | 1–123 | 26–35 | 50–66 | 99–112 | SRDLLLFPSAPLSP (SEQ ID NO: 2623) |
| I107F05 | 735 | 139–249 | 163–173 | 189–195 | 228–238 | 1–123 | 26–35 | 50–66 | 99–112 | SRDLLLFPHAPLAP (SEQ ID NO: 2510) |
| I107F09 | 736 | 139–249 | 163–173 | 189–195 | 228–238 | 1–123 | 26–35 | 50–66 | 99–112 | SRDLLLFPSAPLAP (SEQ ID NO: 2394) |
| I107F10 | 737 | 139–249 | 163–173 | 189–195 | 228–238 | 1–123 | 26–35 | 50–66 | 99–112 | SRDLLLFPRTPLLF (SEQ ID NO: 2373) |
| I107G01 | 738 | 139–249 | 163–173 | 189–195 | 228–238 | 1–123 | 26–35 | 50–66 | 99–112 | SRDLLLFPNAPLSP (SEQ ID NO: 2371) |
| I107G05 | 739 | 139–249 | 163–173 | 189–195 | 228–238 | 1–123 | 26–35 | 50–66 | 99–112 | SRDLLLFPSAPLYP (SEQ ID NO: 2387) |
| I107H02 | 740 | 139–249 | 163–173 | 189–195 | 228–238 | 1–123 | 26–35 | 50–66 | 99–112 | SRDLLLFPHHSFDL (SEQ ID NO: 2147) |
| I107H06 | 741 | 139–249 | 163–173 | 189–195 | 228–238 | 1–123 | 26–35 | 50–66 | 99–112 | SRDLLLFPRAPLSF (SEQ ID NO: 2496) |
| I107H09 | 742 | 139–249 | 163–173 | 189–195 | 228–238 | 1–123 | 26–35 | 50–66 | 99–112 | SRDLLLFPHYPLEM (SEQ ID NO: 2536) |
| I107H10 | 743 | 139–249 | 163–173 | 189–195 | 228–238 | 1–123 | 26–35 | 50–66 | 99–112 | SRDLLLFPHAPLAP (SEQ ID NO: 2510) |
| I108A12 | 744 | 139–249 | 163–173 | 189–195 | 228–238 | 1–123 | 26–35 | 50–66 | 99–112 | SRDLLLFPHHSFDL (SEQ ID NO: 2147) |
| I108B03 | 745 | 139–249 | 163–173 | 189–195 | 228–238 | 1–123 | 26–35 | 50–66 | 99–112 | SRDLLLFPRDPLLF (SEQ ID NO: 2515) |
| I108B04 | 746 | 139–249 | 163–173 | 189–195 | 228–238 | 1–123 | 26–35 | 50–66 | 99–112 | SRDLLLFPLSPLVP (SEQ ID NO: 2396) |
| I108C09 | 747 | 139–249 | 163–173 | 189–195 | 228–238 | 1–123 | 26–35 | 50–66 | 99–112 | SRDLLLFPHDPLGF (SEQ ID NO: 2353) |
| I108C11 | 748 | 139–249 | 163–173 | 189–195 | 228–238 | 1–123 | 26–35 | 50–66 | 99–112 | SRDLLLFPHHSLLF (SEQ ID NO: 2429) |
| I108D10 | 749 | 139–249 | 163–173 | 189–195 | 228–238 | 1–123 | 26–35 | 50–66 | 99–112 | SRDLLLFPASPLNP (SEQ ID NO: 2364) |
| I108D11 | 750 | 139–249 | 163–173 | 189–195 | 228–238 | 1–123 | 26–35 | 50–66 | 99–112 | SRDLLLFPASPLNP (SEQ ID NO: 2364) |
| I108D12 | 751 | 139–249 | 163–173 | 189–195 | 228–238 | 1–123 | 26–35 | 50–66 | 99–112 | SRDLLLFPSAPLNP (SEQ ID NO: 2709) |

TABLE 1-continued scFvs that Immunospecifically Bind to BLyS

| Clone ID | scFv SEQ ID NO | AAs of VL | AAs of VL CDR1 | AAs of VL CDR2 | AAs of VL CDR3 | AAs of VH | AAs of VH CDR1 | AAs of VH CDR2 | AAs of VH CDR3 | VH CDR3 Sequence (SEQ ID NO) |
|---|---|---|---|---|---|---|---|---|---|---|
| I108E01 | 752 | 139–249 | 163–173 | 189–195 | 228–238 | 1–123 | 26–35 | 50–66 | 99–112 | SRDLLLFPHHSFDL (SEQ ID NO: 2147) |
| I108E03 | 753 | 139–249 | 163–173 | 189–195 | 228–238 | 1–123 | 26–35 | 50–66 | 99–112 | SRDLLLFPKHPLRF (SEQ ID NO: 2393) |
| I108E05 | 754 | 139–249 | 163–173 | 189–195 | 228–238 | 1–123 | 26–35 | 50–66 | 99–112 | SRDLLLFPHAPLFP (SEQ ID NO: 2533) |
| I108E07 | 755 | 139–249 | 163–173 | 189–195 | 228–238 | 1–123 | 26–35 | 50–66 | 99–112 | SRDLLLFPHAPLDP (SEQ ID NO: 2369) |
| I108E08 | 756 | 139–249 | 163–173 | 189–195 | 228–238 | 1–123 | 26–35 | 50–66 | 99–112 | SRDLLLFPHYPLLF (SEQ ID NO: 2344) |
| I108E09 | 757 | 139–249 | 163–173 | 189–195 | 228–238 | 1–123 | 26–35 | 50–66 | 99–112 | SRDLLLFPSAPLSP (SEQ ID NO: 2623) |
| I108E10 | 758 | 139–249 | 163–173 | 189–195 | 228–238 | 1–123 | 26–35 | 50–66 | 99–112 | SRDLLLFPRDPLDL (SEQ ID NO: 2509) |
| I108E11 | 759 | 139–249 | 163–173 | 189–195 | 228–238 | 1–123 | 26–35 | 50–66 | 99–112 | SRDLLLFPRDPLEF (SEQ ID NO: 2516) |
| I108F10 | 760 | 139–249 | 163–173 | 189–195 | 228–238 | 1–123 | 26–35 | 50–66 | 99–112 | SRDLLLFPNAPLSP (SEQ ID NO: 2371) |
| I108F12 | 761 | 139–249 | 163–173 | 189–195 | 228–238 | 1–123 | 26–35 | 50–66 | 99–112 | SRDLLLFPHYPFDA (SEQ ID NO: 2508) |
| I108G01 | 762 | 139–249 | 163–173 | 189–195 | 228–238 | 1–123 | 26–35 | 50–66 | 99–112 | SRDLLLFPRDPLRF (SEQ ID NO: 2360) |
| I108G02 | 763 | 139–249 | 163–173 | 189–195 | 228–238 | 1–123 | 26–35 | 50–66 | 99–112 | SRDLLLFPDAPLAP (SEQ ID NO: 2381) |
| I108G07 | 764 | 139–249 | 163–173 | 189–195 | 228–238 | 1–123 | 26–35 | 50–66 | 99–112 | SRDLLLFPRAPLAP (SEQ ID NO: 2476) |
| I108G10 | 765 | 139–249 | 163–173 | 189–195 | 228–238 | 1–123 | 26–35 | 50–66 | 99–112 | SRDLLLFPHHSLLF (SEQ ID NO: 2429) |
| I108G11 | 766 | 139–249 | 163–173 | 189–195 | 228–238 | 1–123 | 26–35 | 50–66 | 99–112 | SRDLLLFPHHPLTF (SEQ ID NO: 2377) |
| I108G12 | 767 | 139–249 | 163–173 | 189–195 | 228–238 | 1–123 | 26–35 | 50–66 | 99–112 | SRDLLLFPHHPLTF (SEQ ID NO: 2377) |
| I108H01 | 768 | 139–249 | 163–173 | 189–195 | 228–238 | 1–123 | 26–35 | 50–66 | 99–112 | SRDLLLFPRDPLHF (SEQ ID NO: 2512) |
| I108H02 | 769 | 139–249 | 163–173 | 189–195 | 228–238 | 1–123 | 26–35 | 50–66 | 99–112 | SRDLLLFPNAPLNP (SEQ ID NO: 2615) |
| I108H06 | 770 | 139–249 | 163–173 | 189–195 | 228–238 | 1–123 | 26–35 | 50–66 | 99–112 | SRDLLLFPHHSFDL (SEQ ID NO: 2147) |
| I108H08 | 771 | 139–249 | 163–173 | 189–195 | 228–238 | 1–123 | 26–35 | 50–66 | 99–112 | SRDLLLFPASPLNP (SEQ ID NO: 2364) |
| I111A06 | 772 | 139–249 | 163–173 | 189–195 | 228–238 | 1–123 | 26–35 | 50–66 | 99–112 | SRDLLLFPQAPLHP (SEQ ID NO: 2691) |
| I111B12 | 773 | 139–249 | 163–173 | 189–195 | 228–238 | 1–123 | 26–35 | 50–66 | 99–112 | SRDLLLFPHHSFDL (SEQ ID NO: 2147) |
| I111C01 | 774 | 139–249 | 163–173 | 189–195 | 228–238 | 1–123 | 26–35 | 50–66 | 99–112 | SRDLLLFPQHGLDL (SEQ ID NO: 2449) |
| I111D06 | 775 | 139–249 | 163–173 | 189–195 | 228–238 | 1–123 | 26–35 | 50–66 | 99–112 | SRDLLLFPRDPLLF (SEQ ID NO: 2515) |
| I111E04 | 776 | 139–249 | 163–173 | 189–195 | 228–238 | 1–123 | 26–35 | 50–66 | 99–112 | SRDLLLFPHHSFDL (SEQ ID NO: 2147) |
| I111E10 | 777 | 139–249 | 163–173 | 189–195 | 228–238 | 1–123 | 26–35 | 50–66 | 99–112 | SRDLLLFPQAPLHP (SEQ ID NO: 2691) |
| I111E11 | 778 | 139–250 | 163–173 | 189–195 | 229–239 | 1–123 | 26–35 | 50–66 | 99–112 | SRDLLLFPHYPLLF (SEQ ID NO: 2344) |
| I111E12 | 779 | 139–249 | 163–173 | 189–195 | 228–238 | 1–123 | 26–35 | 50–66 | 99–112 | SRYLLLFPHHSFDL (SEQ ID NO: 2150) |
| I111F07 | 780 | 139–249 | 163–173 | 189–195 | 228–238 | 1–123 | 26–35 | 50–66 | 99–112 | SRDLLLFPRAPLYP (SEQ ID NO: 2501) |
| I111G02 | 781 | 139–249 | 163–173 | 189–195 | 228–238 | 1–123 | 26–35 | 50–66 | 99–112 | SRDLLLFPKAPLDF (SEQ ID NO: 2534) |
| I111H10 | 782 | 139–249 | 163–173 | 189–195 | 228–238 | 1–123 | 26–35 | 50–66 | 99–112 | SRYLLLFPQHGFDA (SEQ ID NO: 2703) |
| I113A04 | 783 | 139–249 | 163–173 | 189–195 | 228–238 | 1–123 | 26–35 | 50–66 | 99–112 | SRDLLLFPSAPLWP (SEQ ID NO: 2352) |
| I113A12 | 784 | 139–249 | 163–173 | 189–195 | 228–238 | 1–123 | 26–35 | 50–66 | 99–112 | SRDLLLFPQEPLAP (SEQ ID NO: 2434) |
| I113B06 | 785 | 139–249 | 163–173 | 189–195 | 228–238 | 1–123 | 26–35 | 50–66 | 99–112 | SRDLLLFPHHPLEP (SEQ ID NO: 2411) |
| I113C06 | 786 | 139–249 | 163–173 | 189–195 | 228–238 | 1–123 | 26–35 | 50–66 | 99–112 | SRDLLLFPHHGFDA (SEQ ID NO: 2406) |
| I113G04 | 787 | 139–249 | 163–173 | 189–195 | 228–238 | 1–123 | 26–35 | 50–66 | 99–112 | SRDLLLFPHYPLLF (SEQ ID NO: 2344) |
| I113G05 | 788 | 139–249 | 163–173 | 189–195 | 228–238 | 1–123 | 26–35 | 50–66 | 99–112 | SRDLLLFPHYSLLL (SEQ ID NO: 2517) |
| I113G10 | 789 | 139–249 | 163–173 | 189–195 | 228–238 | 1–123 | 26–35 | 50–66 | 99–112 | SRDLLLFPHHPLQF (SEQ ID NO: 2413) |
| I113G11 | 790 | 139–249 | 163–173 | 189–195 | 228–238 | 1–123 | 26–35 | 50–66 | 99–112 | SRDLLLFPHYPLLF (SEQ ID NO: 2344) |
| I113H06 | 791 | 139–249 | 163–173 | 189–195 | 228–238 | 1–123 | 26–35 | 50–66 | 99–112 | SRDLLLFPHYPLLF (SEQ ID NO: 2344) |
| I113H07 | 792 | 139–249 | 163–173 | 189–195 | 228–238 | 1–123 | 26–35 | 50–66 | 99–112 | SRDLLLFPHHSFDL (SEQ ID NO: 2147) |
| I113H09 | 793 | 139–249 | 163–173 | 189–195 | 228–238 | 1–123 | 26–35 | 50–66 | 99–112 | SRDLLLFPHYTLLF (SEQ ID NO: 2525) |
| I114C04 | 794 | 139–249 | 163–173 | 189–195 | 228–238 | 1–123 | 26–35 | 50–66 | 99–112 | SRDLLLFPHHGFDA (SEQ ID NO: 2406) |
| I114C12 | 795 | 139–249 | 163–173 | 189–195 | 228–238 | 1–123 | 26–35 | 50–66 | 99–112 | SRDLLLFPQAPLHP (SEQ ID NO: 2691) |
| I114D04 | 796 | 139–249 | 163–173 | 189–195 | 228–238 | 1–123 | 26–35 | 50–66 | 99–112 | SRDLLLFPHYGMDV (SEQ ID NO: 2133) |
| I114D06 | 797 | 139–249 | 163–173 | 189–195 | 228–238 | 1–123 | 26–35 | 50–66 | 99–112 | SRDLLLFPHHSFDL (SEQ ID NO: 2147) |
| I114D10 | 798 | 139–249 | 163–173 | 189–195 | 228–238 | 1–123 | 26–35 | 50–66 | 99–112 | SRDLLLFPHYSLVL (SEQ ID NO: 2521) |

TABLE 1-continued scFvs that Immunospecifically Bind to BLyS

| Clone ID | scFv SEQ ID NO | AAs of VL | AAs of VL CDR1 | AAs of VL CDR2 | AAs of VL CDR3 | AAs of VH | AAs of VH CDR1 | AAs of VH CDR2 | AAs of VH CDR3 | VH CDR3 Sequence (SEQ ID NO) |
|---|---|---|---|---|---|---|---|---|---|---|
| I114E01 | 799 | 139–249 | 163–173 | 189–195 | 228–238 | 1–123 | 26–35 | 50–66 | 99–112 | SRDLLLFPQEPLSP (SEQ ID NO: 2435) |
| I114E02 | 800 | 139–249 | 163–173 | 189–195 | 228–238 | 1–123 | 26–35 | 50–66 | 99–112 | SRDLLLFPQESFSL (SEQ ID NO: 2437) |
| I114E03 | 801 | 139–249 | 163–173 | 189–195 | 228–238 | 1–123 | 26–35 | 50–66 | 99–112 | SRDLLLFPKAPLTF (SEQ ID NO: 2382) |
| I114E11 | 802 | 139–249 | 163–173 | 189–195 | 228–238 | 1–123 | 26–35 | 50–66 | 99–112 | SRDLLLFPHDSFFL (SEQ ID NO: 2383) |
| I114H01 | 803 | 139–249 | 163–173 | 189–195 | 228–238 | 1–123 | 26–35 | 50–66 | 99–112 | SRDLLLFPHHSFDL (SEQ ID NO: 2147) |
| I114H06 | 804 | 139–249 | 163–173 | 189–195 | 228–238 | 1–123 | 26–35 | 50–66 | 99–112 | SRDLLLFPHHALDV (SEQ ID NO: 2404) |
| I114H09 | 805 | 139–249 | 163–173 | 189–195 | 228–238 | 1–123 | 26–35 | 50–66 | 99–112 | SRDLLLFPHHSFDL (SEQ ID NO: 2147) |
| I115A02 | 806 | 139–249 | 163–173 | 189–195 | 228–238 | 1–123 | 26–35 | 50–66 | 99–112 | SRYLLLFPDHSFDL (SEQ ID NO: 2684) |
| I115A07 | 807 | 139–249 | 163–173 | 189–195 | 228–238 | 1–123 | 26–35 | 50–66 | 99–112 | SRDLLLFPHYPLLF (SEQ ID NO: 2344) |
| I115B10 | 808 | 139–249 | 163–173 | 189–195 | 228–238 | 1–123 | 26–35 | 50–66 | 99–112 | SRDLLLFPHHSFDL (SEQ ID NO: 2147) |
| I115C05 | 809 | 139–249 | 163–173 | 189–195 | 228–238 | 1–123 | 26–35 | 50–66 | 99–112 | SRDLLLFPRAPLYP (SEQ ID NO: 2501) |
| I115C06 | 810 | 139–249 | 163–173 | 189–195 | 228–238 | 1–123 | 26–35 | 50–66 | 99–112 | SRYLLLFPHHSFDL (SEQ ID NO: 2150) |
| I115C08 | 811 | 139–249 | 163–173 | 189–195 | 228–238 | 1–123 | 26–35 | 50–66 | 99–112 | SRDLLLFPHHSFDL (SEQ ID NO: 2147) |
| I115C12 | 812 | 139–249 | 163–173 | 189–195 | 228–238 | 1–123 | 26–35 | 50–66 | 99–112 | SRDLLLFPHHSFDT (SEQ ID NO: 2424) |
| I115D07 | 813 | 139–249 | 163–173 | 189–195 | 228–238 | 1–123 | 26–35 | 50–66 | 99–112 | SRDLLLFPHYPLLF (SEQ ID NO: 2344) |
| I115E09 | 814 | 139–249 | 163–173 | 189–195 | 228–238 | 1–123 | 26–35 | 50–66 | 99–112 | SRDLLLFPHHRFDL (SEQ ID NO: 2418) |
| I115F06 | 815 | 139–249 | 163–173 | 189–195 | 228–238 | 1–123 | 26–35 | 50–66 | 99–112 | SRYLLLFPHYGMDV (SEQ ID NO: 2685) |
| I115F07 | 816 | 139–249 | 163–173 | 189–195 | 228–238 | 1–123 | 26–35 | 50–66 | 99–112 | SRYLLLFPHYPLLF (SEQ ID NO: 2686) |
| I115F12 | 817 | 139–249 | 163–173 | 189–195 | 228–238 | 1–123 | 26–35 | 50–66 | 99–112 | SRYLLLFPHHSFDL (SEQ ID NO: 2150) |
| I115G04 | 818 | 139–249 | 163–173 | 189–195 | 228–238 | 1–123 | 26–35 | 50–66 | 99–112 | SRDLLLFPHHRFDL (SEQ ID NO: 2418) |
| I115G05 | 819 | 139–249 | 163–173 | 189–195 | 228–238 | 1–123 | 26–35 | 50–66 | 99–112 | SRDLLLFPHYPLLF (SEQ ID NO: 2344) |
| I115G08 | 820 | 139–249 | 163–173 | 189–195 | 228–238 | 1–123 | 26–35 | 50–66 | 99–112 | SRDLLLFPHDSFDL (SEQ ID NO: 2631) |
| I115H04 | 821 | 139–249 | 163–173 | 189–195 | 228–238 | 1–123 | 26–35 | 50–66 | 99–112 | SRDLLLFPHANLSP (SEQ ID NO: 2503) |
| I115H07 | 822 | 139–249 | 163–173 | 189–195 | 228–238 | 1–123 | 26–35 | 50–66 | 99–112 | SRDLLLFPHYPLLF (SEQ ID NO: 2344) |
| I115H09 | 823 | 139–249 | 163–173 | 189–195 | 228–238 | 1–123 | 26–35 | 50–66 | 99–112 | SRDLLLFPHHRFDL (SEQ ID NO: 2418) |
| I116A07 | 824 | 139–249 | 163–173 | 189–195 | 228–238 | 1–123 | 26–35 | 50–66 | 99–112 | SRDLLLFPYEPLRF (SEQ ID NO: 2642) |
| I116B01 | 825 | 139–249 | 163–173 | 189–195 | 228–238 | 1–123 | 26–35 | 50–66 | 99–112 | SRDLLLFPHHSFDL (SEQ ID NO: 2147) |
| I116B12 | 826 | 139–249 | 163–173 | 189–195 | 228–238 | 1–123 | 26–35 | 50–66 | 99–112 | SRDLLLFPHHSFDL (SEQ ID NO: 2147) |
| I116C06 | 827 | 139–249 | 163–173 | 189–195 | 228–238 | 1–123 | 26–35 | 50–66 | 99–112 | SRDLLLFPHYPLLF (SEQ ID NO: 2344) |
| I116D07 | 828 | 139–249 | 163–173 | 189–195 | 228–238 | 1–123 | 26–35 | 50–66 | 99–112 | SRDLLLFPHHSFDL (SEQ ID NO: 2147) |
| I116E02 | 829 | 139–249 | 163–173 | 189–195 | 228–238 | 1–123 | 26–35 | 50–66 | 99–112 | SRDLLLFPHHRFDL (SEQ ID NO: 2418) |
| I116E04 | 830 | 139–249 | 163–173 | 189–195 | 228–238 | 1–123 | 26–35 | 50–66 | 99–112 | SRDLLLFPHHSFDL (SEQ ID NO: 2147) |
| I116F02 | 831 | 139–249 | 163–173 | 189–195 | 228–238 | 1–123 | 26–35 | 50–66 | 99–112 | SRYLLLFPHHSFDL (SEQ ID NO: 2150) |
| I116F11 | 832 | 139–249 | 163–173 | 189–195 | 228–238 | 1–123 | 26–35 | 50–66 | 99–112 | SRDLLLFPHYPLLF (SEQ ID NO: 2344) |
| I116G05 | 833 | 139–249 | 163–173 | 189–195 | 228–238 | 1–123 | 26–35 | 50–66 | 99–112 | SRDLLLFPQAPLSP (SEQ ID NO: 2699) |
| I001C09 | 834 | 143–250 | 164–174 | 190–196 | 229–239 | 1–127 | 26–35 | 50–66 | 99–116 | DGSYDILTGYYIDNYMDV (SEQ ID NO: 2154) |
| I006D07 | 835 | 141–248 | 162–172 | 188–194 | 227–237 | 1–125 | 26–35 | 50–66 | 99–114 | SHYDILTGLNYWYFDL (SEQ ID NO: 2166) |
| I007B03 | 836 | 143–253 | 165–178 | 194–200 | 233–242 | 1–127 | 26–35 | 50–66 | 99–116 | DGSYDILTGYYIDNYMDV (SEQ ID NO: 2154) |
| I007F11 | 837 | 140–250 | 162–175 | 191–197 | 230–239 | 1–124 | 26–35 | 50–66 | 99–113 | DGIDILLVPAALMDV (SEQ ID NO: 2160) |
| I007H08 | 838 | 144–254 | 166–179 | 195–201 | 234–243 | 1–128 | 26–37 | 52–69 | 102–117 | DRYDILTGYYYYGMDV (SEQ ID NO: 2129) |
| I008A09 | 839 | 146–256 | 168–181 | 197–203 | 236–245 | 1–130 | 26–35 | 50–66 | 99–119 | DREAYYDILTGYYLYYYYMDV (SEQ ID NO: 2172) |
| I008B01 | 840 | 141–251 | 163–176 | 192–198 | 231–240 | 1–125 | 26–35 | 50–66 | 99–114 | ATYDPLTGYSFDGFDI (SEQ ID NO: 2153) |
| I008C02 | 841 | 145–255 | 167–180 | 196–202 | 235–244 | 1–129 | 26–37 | 52–67 | 100–118 | HVRDYDILTGYYRGHYFDY (SEQ ID NO: 2167) |
| I008C03 | 842 | 143–250 | 164–174 | 190–196 | 229–239 | 1–127 | 26–35 | 50–65 | 98–116 | EGSYDILTGYYVGVGRMDV (SEQ ID NO: 2171) |
| I008C12 | 843 | 146–256 | 168–181 | 197–203 | 236–245 | 1–130 | 26–35 | 50–68 | 101–119 | FNPTYDILTGYYIGGYFQH (SEQ ID NO: 2155) |
| I012A06 | 844 | 145–254 | 169–179 | 195–201 | 234–243 | 1–129 | 26–37 | 52–67 | 100–118 | GRWDYDLLTGEHLGYYFDY (SEQ ID NO: 2162) |
| I016E05 | 845 | 141–251 | 163–176 | 192–198 | 231–240 | 1–125 | 26–35 | 50–66 | 99–114 | ATYDPLTGYSFDGFDI (SEQ ID NO: 2153) |

TABLE 1-continued scFvs that Immunospecifically Bind to BLyS

| Clone ID | scFv SEQ ID NO | AAs of VL | AAs of VL CDR1 | AAs of VL CDR2 | AAs of VL CDR3 | AAs of VH | AAs of VH CDR1 | AAs of VH CDR2 | AAs of VH CDR3 | VH CDR3 Sequence (SEQ ID NO) |
|---|---|---|---|---|---|---|---|---|---|---|
| I016F02 | 846 | 135–245 | 157–170 | 186–192 | 225–234 | 1–119 | 26–35 | 50–66 | 99–108 | GMGDHYGMDV (SEQ ID NO: 2161) |
| I016F04 | 847 | 141–251 | 163–176 | 192–198 | 231–240 | 1–125 | 26–35 | 50–66 | 99–114 | ATYDPLTGYSFDGFDI (SEQ ID NO: 2153) |
| I016H07 | 848 | 141–248 | 162–172 | 188–194 | 227–237 | 1–125 | 26–35 | 50–66 | 99–114 | GYHDPLTSYNYNWFDP (SEQ ID NO: 2163) |
| I018C02 | 849 | 141–251 | 163–176 | 192–198 | 231–240 | 1–125 | 26–35 | 50–66 | 99–114 | ATYDPLTGYSFDGFDI (SEQ ID NO: 2153) |
| I018C10 | 850 | 143–250 | 164–174 | 190–196 | 229–239 | 1–127 | 26–35 | 50–66 | 99–116 | DGSYDILTGYYIDNYMDV (SEQ ID NO: 2154) |
| I018D07 | 851 | 143–250 | 164–174 | 190–196 | 229–239 | 1–127 | 26–35 | 50–66 | 99–116 | DGSYDILTGYYIDNYMDV (SEQ ID NO: 2154) |
| I018H08 | 852 | 141–251 | 163–176 | 192–198 | 231–240 | 1–125 | 26–35 | 50–66 | 99–114 | ATYDPLTGYSFDGFDI (SEQ ID NO: 2153) |
| I018H09 | 853 | 141–251 | 163–176 | 192–198 | 231–240 | 1–125 | 26–35 | 50–66 | 99–114 | ATYDPLTGYSFDGFDI (SEQ ID NO: 2153) |
| I021B05 | 854 | 143–253 | 165–178 | 194–200 | 233–242 | 1–127 | 24–33 | 48–64 | 97–116 | EGGNYDILTGYYIGNGAFDI (SEQ ID NO: 2158) |
| I022E02 | 855 | 141–251 | 163–176 | 192–198 | 231–240 | 1–125 | 26–35 | 50–66 | 99–114 | ATYDPLTGYSFDGLDI (SEQ ID NO: 2157) |
| I026E03 | 856 | 141–251 | 165–175 | 191–197 | 230–240 | 1–125 | 26–35 | 50–66 | 99–114 | TDYDILTGYPMGYFDP (SEQ ID NO: 2173) |
| I027A07 | 857 | 144–255 | 167–179 | 195–201 | 234–244 | 1–128 | 26–35 | 50–66 | 99–117 | GGEYDILTGYYFGLGVYDY (SEQ ID NO: 2170) |
| I028A06 | 858 | 142–253 | 164–176 | 192–198 | 231–242 | 1–126 | 26–35 | 50–66 | 99–115 | GGDYDILTGLYYYGMDV (SEQ ID NO: 2156) |
| I029D07 | 859 | 141–250 | 163–176 | 192–198 | 231–239 | 1–125 | 26–35 | 50–66 | 99–114 | ATYDPLTGYSFDGFDI (SEQ ID NO: 2153) |
| I029F11 | 860 | 143–253 | 165–177 | 193–199 | 232–242 | 1–127 | 26–35 | 50–66 | 99–116 | DGSYDILTGYYIDNYMDV (SEQ ID NO: 2154) |
| I031C03 | 861 | 137–248 | 160–172 | 188–194 | 227–237 | 1–121 | 26–35 | 50–66 | 99–110 | GYDSSAFRAFDI (SEQ ID NO: 2136) |
| I031C07 | 862 | 147–258 | 170–183 | 199–205 | 238–247 | 1–131 | 26–35 | 50–66 | 99–120 | SSPPRWYDALTGDSSYHSAMDV (SEQ ID NO: 2169) |
| I031F09 | 863 | 143–255 | 167–179 | 195–201 | 234–244 | 1–127 | 26–35 | 50–66 | 99–116 | DEGRDLLTGYYWPNFFDS (SEQ ID NO: 2168) |
| I031G08 | 864 | 147–259 | 170–182 | 198–204 | 237–248 | 1–131 | 26–35 | 50–66 | 99–120 | SSPPKWYDALTGHSSYHSAMDV (SEQ ID NO: 2159) |
| I031G10 | 865 | 147–258 | 170–182 | 198–204 | 237–247 | 1–131 | 26–35 | 50–66 | 99–120 | SSPPKWYDALTGDSSYHSAMDV (SEQ ID NO: 2165) |
| I031G11 | 866 | 143–255 | 167–179 | 195–201 | 234–244 | 1–127 | 26–35 | 50–66 | 99–116 | DEGRDLLTGYYWPNFFDS (SEQ ID NO: 2168) |
| I037E07 | 867 | 140–250 | 162–175 | 191–197 | 230–239 | 1–124 | 26–35 | 50–66 | 99–113 | DGIDILLVPAALMDV (SEQ ID NO: 2160) |
| I037E12 | 868 | 140–250 | 162–175 | 191–197 | 230–239 | 1–124 | 26–35 | 50–66 | 99–113 | DGIDILLVPAALMDV (SEQ ID NO: 2160) |
| I050A07 | 869 | 145–257 | 168–181 | 197–203 | 236–246 | 1–129 | 26–40 | 55–71 | 104–118 | QDNDPLTGYKLGFDY (SEQ ID NO: 2164) |
| I061D02 | 870 | 144–254 | 166–179 | 195–201 | 234–243 | 1–128 | 26–37 | 52–69 | 102–117 | DRYDILTGYYYYGMDV (SEQ ID NO: 2129) |
| I061E07 | 871 | 141–251 | 163–175 | 191–197 | 230–240 | 1–125 | 26–35 | 50–66 | 99–114 | ATYDPLTGYSFDGFDI (SEQ ID NO: 2153) |
| I061H01 | 872 | 146–256 | 168–181 | 197–203 | 236–245 | 1–130 | 26–35 | 50–68 | 101–119 | FNPTYDILTGYYIGGYFQH (SEQ ID NO: 2155) |
| I001A03 | 873 | 144–254 | 166–179 | 195–201 | 234–243 | 1–128 | 26–35 | 50–66 | 99–117 | ERHYYDILTGYQTGYGMDV (SEQ ID NO: 2784) |
| I001A07 | 874 | 141–251 | 163–176 | 192–198 | 231–240 | 1–125 | 26–35 | 50–66 | 99–114 | ATYDPLTGYSFDGFDI (SEQ ID NO: 2153) |
| I001A08 | 875 | 141–251 | 163–176 | 192–198 | 231–240 | 1–125 | 26–35 | 50–66 | 99–114 | ATYDPLTGYSFDGFDI (SEQ ID NO: 2153) |
| I001A10 | 876 | 141–251 | 163–176 | 192–198 | 231–240 | 1–125 | 26–35 | 50–66 | 99–114 | ATYDPLTGYSFDGFDI (SEQ ID NO: 2153) |
| I001A12 | 877 | 141–248 | 162–172 | 188–194 | 227–237 | 1–125 | 26–35 | 50–66 | 99–114 | ATYDPLTGYSFDGFDI (SEQ ID NO: 2153) |
| I001B02 | 878 | 137–247 | 159–171 | 187–193 | 226–236 | 1–121 | 26–35 | 50–66 | 99–110 | DRETKVGYGMDV (SEQ ID NO: 2945) |
| I001B07 | 879 | 141–251 | 163–176 | 192–198 | 231–240 | 1–125 | 26–35 | 50–66 | 99–114 | ATYDPLTGYSFDGFDI (SEQ ID NO: 2153) |
| I001C06 | 880 | 143–253 | 165–178 | 194–200 | 233–242 | 1–127 | 24–33 | 48–64 | 97–116 | EGGNYDILTGYYIGNGAFDI (SEQ ID NO: 2158) |
| I001C08 | 881 | 144–254 | 166–179 | 195–201 | 234–243 | 1–128 | 26–35 | 50–66 | 99–117 | EGSYDILTGYYVGVGRMDV (SEQ ID NO: 2171) |
| I001C12 | 882 | 141–251 | 163–176 | 192–198 | 231–240 | 1–125 | 26–35 | 50–66 | 99–114 | ATYDPLTGYSFDGFDI (SEQ ID NO: 2153) |
| I001D08 | 883 | 140–250 | 162–175 | 191–197 | 230–239 | 1–124 | 26–35 | 50–65 | 98–113 | DSYDILTGYRGYYFDY (SEQ ID NO: 2745) |
| I001D12 | 884 | 141–251 | 163–176 | 192–198 | 231–240 | 1–125 | 26–35 | 50–66 | 99–114 | ATYDPLTGYSFDGFDI (SEQ ID NO: 2153) |
| I001E05 | 885 | 143–253 | 165–178 | 194–200 | 233–242 | 1–127 | 24–33 | 48–64 | 97–116 | EGGNYDILTGYYIGNGAFDI (SEQ ID NO: 2158) |
| I001E07 | 886 | 141–251 | 163–176 | 192–198 | 231–240 | 1–125 | 26–35 | 50–66 | 99–114 | ATYDPLTGYSFDGFDI (SEQ ID NO: 2153) |
| I001G09 | 887 | 141–251 | 163–176 | 192–198 | 231–240 | 1–125 | 26–35 | 50–66 | 99–114 | ATYDPLTGYSFDGFDI (SEQ ID NO: 2153) |
| I001H05 | 888 | 144–254 | 166–179 | 195–201 | 234–243 | 1–128 | 26–35 | 50–66 | 99–117 | ERHYYDILTGYQTGYGMDV (SEQ ID NO: 2784) |
| I001H08 | 889 | 141–251 | 163–176 | 192–198 | 231–240 | 1–125 | 26–35 | 50–66 | 99–114 | ATYDPLTGYSFDGFDI (SEQ ID NO: 2153) |
| I003A01 | 890 | 140–251 | 163–176 | 192–198 | 231–240 | 1–124 | 26–34 | 49–65 | 98–113 | ELGSSIVGATTGALDM (SEQ ID NO: 2852) |
| I003A06 | 891 | 140–251 | 163–176 | 192–198 | 231–240 | 1–124 | 26–34 | 49–65 | 98–113 | ELGSSIVGATTGALDM (SEQ ID NO: 2852) |
| I003A07 | 892 | 142–249 | 163–173 | 189–195 | 228–238 | 1–126 | 26–35 | 50–66 | 99–115 | DGYYDILTGYSYYGMDV (SEQ ID NO: 2135) |

TABLE 1-continued scFvs that Immunospecifically Bind to BLyS

| Clone ID | scFv SEQ ID NO | AAs of VL | AAs of VL CDR1 | AAs of VL CDR2 | AAs of VL CDR3 | AAs of VH | AAs of VH CDR1 | AAs of VH CDR2 | AAs of VH CDR3 | VH CDR3 Sequence (SEQ ID NO) |
|---|---|---|---|---|---|---|---|---|---|---|
| I003A10 | 893 | 141–248 | 162–172 | 188–194 | 227–237 | 1–125 | 26–35 | 50–66 | 99–114 | MEYDILTGYYGGYFDY (SEQ ID NO: 2179) |
| I003B03 | 894 | 140–251 | 163–176 | 192–198 | 231–240 | 1–124 | 26–34 | 49–65 | 98–113 | ELGSSIVGATTGALDM (SEQ ID NO: 2852) |
| I003B04 | 895 | 138–248 | 162–172 | 188–194 | 227–237 | 1–122 | 25–34 | 49–65 | 98–111 | RYGDPFYYYYYMNV (SEQ ID NO: 2755) |
| I003B09 | 896 | 142–249 | 163–173 | 189–195 | 228–238 | 1–126 | 26–35 | 50–66 | 99–115 | DGYYDILTGYSYYGMDV (SEQ ID NO: 2135) |
| I003C01 | 897 | 140–252 | 164–176 | 192–198 | 231–241 | 1–124 | 26–34 | 49–65 | 98–113 | ELGLSIVGATTGALDM (SEQ ID NO: 2174) |
| I003C02 | 898 | 141–252 | 164–176 | 192–198 | 231–241 | 1–125 | 26–35 | 50–66 | 99–114 | GDYDILTGYPAECFQI (SEQ ID NO: 2854) |
| I003C03 | 899 | 141–250 | 164–174 | 190–196 | 229–239 | 1–125 | 26–35 | 50–66 | 99–114 | GDYDILTGYPAECFQI (SEQ ID NO: 2854) |
| I003C12 | 900 | 141–248 | 162–172 | 188–194 | 227–237 | 1–125 | 26–35 | 50–66 | 99–114 | MEYDILTGYYGGYFDY (SEQ ID NO: 2179) |
| I003D04 | 901 | 139–250 | 162–174 | 190–196 | 229–239 | 1–123 | 26–35 | 50–66 | 99–112 | RYGDPFYYYYYMNV (SEQ ID NO: 2755) |
| I003E05 | 902 | 141–253 | 164–176 | 192–198 | 231–242 | 1–125 | 26–35 | 50–66 | 99–114 | GDYDILTGYPAECFQI (SEQ ID NO: 2854) |
| I003F01 | 903 | 140–251 | 163–176 | 192–198 | 231–240 | 1–124 | 26–34 | 49–65 | 98–113 | ELGSSIVGATTGALDM (SEQ ID NO: 2852) |
| I003F02 | 904 | 139–251 | 162–175 | 191–197 | 230–240 | 1–123 | 26–35 | 50–66 | 99–112 | RYGDPFYYYYYMNV (SEQ ID NO: 2755) |
| I003G01 | 905 | 143–254 | 168–179 | 195–201 | 234–243 | 1–127 | 26–35 | 50–66 | 99–116 | GTGYDILTGYYMGSAFDQ (SEQ ID NO: 2800) |
| I003G05 | 906 | 143–255 | 166–179 | 195–201 | 234–244 | 1–127 | 26–35 | 50–66 | 99–116 | GSGYDLLTGYFTGSPLDY (SEQ ID NO: 2766) |
| I003G06 | 907 | 145–256 | 168–181 | 197–203 | 236–245 | 1–129 | 26–35 | 50–66 | 99–118 | DRGGNYDILTGYYFHHGVDV (SEQ ID NO: 2914) |
| I003G11 | 908 | 144–251 | 165–175 | 191–197 | 230–240 | 1–128 | 26–35 | 50–66 | 99–117 | DAQSYYDILTGYQSYAFDI (SEQ ID NO: 2183) |
| I003H02 | 909 | 140–253 | 164–176 | 192–198 | 233–242 | 1–124 | 26–35 | 50–66 | 99–113 | DNYDILTGYSRRFDP (SEQ ID NO: 2942) |
| I003H05 | 910 | 140–251 | 163–176 | 192–198 | 231–240 | 1–124 | 26–34 | 49–65 | 98–113 | ELGSSIVGATTGALDM (SEQ ID NO: 2852) |
| I003H08 | 911 | 142–249 | 163–173 | 189–195 | 228–238 | 1–126 | 26–35 | 50–66 | 99–115 | DGYYDILTGYSYYGMDV (SEQ ID NO: 2135) |
| I005A01 | 912 | 141–249 | 162–172 | 188–194 | 227–238 | 1–125 | 26–35 | 50–66 | 99–114 | SHYDILTGLNYWYFDL (SEQ ID NO: 2166) |
| I005A02 | 913 | 141–248 | 162–172 | 188–194 | 227–237 | 1–125 | 26–35 | 50–66 | 99–114 | EGRDILTGVYYYGLDV (SEQ ID NO: 2893) |
| I005B01 | 914 | 141–248 | 162–172 | 188–194 | 227–237 | 1–125 | 26–35 | 50–66 | 99–114 | SHYDILTGLNYWYFDL (SEQ ID NO: 2166) |
| I005B09 | 915 | 137–247 | 159–172 | 188–194 | 227–236 | 1–121 | 26–35 | 50–65 | 98–110 | TYYDILTGRFFDI (SEQ ID NO: 2866) |
| I005C01 | 916 | 141–248 | 162–172 | 188–194 | 227–237 | 1–125 | 26–35 | 50–66 | 99–114 | SHYDILTGLNYWYFDL (SEQ ID NO: 2166) |
| I005D02 | 917 | 141–251 | 163–176 | 192–198 | 231–240 | 1–125 | 26–35 | 50–66 | 99–114 | DLRYDILTGYHDAFDI (SEQ ID NO: 2890) |
| I005D03 | 918 | 142–249 | 165–175 | 191–197 | 230–238 | 1–126 | 26–35 | 50–66 | 99–115 | GAYYDILTGYYPYGMDV (SEQ ID NO: 2860) |
| I005E01 | 919 | 142–249 | 165–175 | 191–197 | 230–238 | 1–126 | 26–35 | 50–66 | 99–115 | GTYYDILTGYFHYGMDV (SEQ ID NO: 2774) |
| I005E08 | 920 | 141–248 | 162–172 | 188–194 | 227–237 | 1–125 | 26–35 | 50–66 | 99–114 | SHYDILTGLNYWYFDL (SEQ ID NO: 2166) |
| I005F01 | 921 | 140–248 | 164–174 | 190–196 | 229–238 | 1–124 | 26–35 | 50–66 | 99–113 | DQHDILTGVYYGMDV (SEQ ID NO: 2921) |
| I005F02 | 922 | 144–251 | 167–177 | 193–199 | 232–240 | 1–128 | 26–35 | 50–66 | 99–117 | VSPSYDILTGYYLPHAFDV (SEQ ID NO: 2849) |
| I005F04 | 923 | 137–247 | 159–172 | 188–194 | 227–236 | 1–121 | 26–35 | 50–65 | 98–110 | TYYDILTGRFFDI (SEQ ID NO: 2866) |
| I005F08 | 924 | 140–247 | 161–171 | 187–193 | 226–236 | 1–124 | 26–35 | 50–66 | 99–113 | PSYDILTGYLYYFDY (SEQ ID NO: 2850) |
| I005G01 | 925 | 141–251 | 163–176 | 192–198 | 231–240 | 1–125 | 26–35 | 50–66 | 99–114 | DLRYDILTGYHDAFDI (SEQ ID NO: 2890) |
| I005G08 | 926 | 142–249 | 165–175 | 191–197 | 230–238 | 1–126 | 26–35 | 50–66 | 99–115 | GAYYDILTGYYPYGMDV (SEQ ID NO: 2860) |
| I005H02 | 927 | 140–247 | 161–171 | 187–193 | 226–236 | 1–124 | 26–35 | 50–66 | 99–113 | GQYYDILTGYNWFDP (SEQ ID NO: 2857) |
| I006B01 | 928 | 139–246 | 160–170 | 186–192 | 225–235 | 1–123 | 26–35 | 50–66 | 99–112 | SRDLLLFPHYGMDV (SEQ ID NO: 2133) |
| I006C09 | 929 | 143–253 | 165–177 | 193–199 | 232–242 | 1–127 | 26–35 | 50–66 | 99–116 | GGYSSGWLRGGPYNWFDP (SEQ ID NO: 2967) |
| I006D09 | 930 | 141–251 | 163–176 | 192–198 | 231–240 | 1–125 | 26–35 | 50–66 | 99–114 | GDYDILTGYYIPLRDY (SEQ ID NO: 2792) |
| I006E01 | 931 | 143–253 | 165–178 | 194–200 | 233–242 | 1–127 | 26–35 | 50–68 | 101–116 | NLFDVWTLPYYYYMDV (SEQ ID NO: 2965) |
| I006E07 | 932 | 143–250 | 166–176 | 192–198 | 231–239 | 1–127 | 26–35 | 50–66 | 99–116 | ADYDILTGYSPLTYGMDV (SEQ ID NO: 2762) |
| I006F01 | 933 | 140–250 | 162–175 | 191–197 | 230–239 | 1–124 | 26–35 | 50–68 | 101–113 | MYYDILTGHNFDY (SEQ ID NO: 2879) |
| I006F02 | 934 | 142–253 | 164–176 | 192–198 | 231–242 | 1–126 | 26–35 | 50–66 | 99–115 | VSRDILTGNYYYYGMDV (SEQ ID NO: 2817) |
| I006F07 | 935 | 143–253 | 165–177 | 193–199 | 232–242 | 1–127 | 26–35 | 50–66 | 99–116 | GGYSSGWLRGGPYNWFDP (SEQ ID NO: 2967) |
| I006G01 | 936 | 146–253 | 169–179 | 195–201 | 234–242 | 1–130 | 26–35 | 50–68 | 101–119 | AGGYYDILTGRDYYYGMDV (SEQ ID NO: 2877) |
| I006G04 | 937 | 132–239 | 153–163 | 179–185 | 218–228 | 1–116 | 26–35 | 50–66 | 99–105 | RRYALDY (SEQ ID NO: 2920) |
| I006H01 | 938 | 146–253 | 167–177 | 193–199 | 232–242 | 1–130 | 26–35 | 50–65 | 98–119 | DRGSYDILTGYYTPPHYYGMDV (SEQ ID NO: 2761) |
| I006H02 | 939 | 143–253 | 165–177 | 193–199 | 232–242 | 1–127 | 26–35 | 50–66 | 99–116 | GGYSSGWLRGGPYNWFDP (SEQ ID NO: 2967) |

TABLE 1-continued scFvs that Immunospecifically Bind to BLyS

| Clone ID | scFv SEQ ID NO | AAs of VL | AAs of VL CDR1 | AAs of VL CDR2 | AAs of VL CDR3 | AAs of VH | AAs of VH CDR1 | AAs of VH CDR2 | AAs of VH CDR3 | VH CDR3 Sequence (SEQ ID NO) |
|---|---|---|---|---|---|---|---|---|---|---|
| I007A01 | 940 | 141–251 | 163–176 | 192–198 | 231–240 | 1–125 | 26–35 | 50–66 | 99–114 | ATYDPLTGYSFDGFDI (SEQ ID NO: 2153) |
| I007A08 | 941 | 139–249 | 161–174 | 190–196 | 229–238 | 1–123 | 26–35 | 50–66 | 99–114 | SHYDILTGLNYWYFDY (SEQ ID NO: 2746) |
| I007A11 | 942 | 140–250 | 162–175 | 191–197 | 230–239 | 1–124 | 26–35 | 50–66 | 99–113 | ENYDFLTGYYGAFDI (SEQ ID NO: 2772) |
| I007A12 | 943 | 144–251 | 165–175 | 191–197 | 230–240 | 1–128 | 26–35 | 50–68 | 101–117 | GIYDILTGYHWDGAFDI (SEQ ID NO: 2892) |
| I007B04 | 944 | 141–251 | 163–176 | 192–198 | 231–240 | 1–125 | 26–35 | 50–66 | 99–114 | ATYDPLTGYSFDGFDI (SEQ ID NO: 2153) |
| I007C04 | 945 | 141–251 | 163–176 | 192–198 | 231–240 | 1–125 | 26–35 | 50–66 | 99–114 | ATYDPLTGYSFDGFDI (SEQ ID NO: 2153) |
| I007C08 | 946 | 142–249 | 163–173 | 189–195 | 228–238 | 1–126 | 26–35 | 50–65 | 98–115 | IRLYCYSLTGYYPYGMDD (SEQ ID NO: 2810) |
| I007C12 | 947 | 140–250 | 162–175 | 191–197 | 230–239 | 1–124 | 26–35 | 50–66 | 99–113 | TNYDILTGYYQGVDY (SEQ ID NO: 2782) |
| I007D07 | 948 | 140–247 | 161–171 | 187–193 | 226–236 | 1–124 | 26–35 | 50–66 | 99–113 | GQYYDILTGYNWFDP (SEQ ID NO: 2857) |
| I007D08 | 949 | 144–251 | 165–175 | 191–197 | 230–240 | 1–128 | 26–35 | 50–68 | 101–117 | GIYDILTGYHWDDAFDI (SEQ ID NO: 2872) |
| I007E03 | 950 | 141–248 | 162–172 | 188–194 | 227–237 | 1–125 | 26–35 | 50–66 | 99–114 | ATYDPLTGYSFDGFDI (SEQ ID NO: 2153) |
| I007E10 | 951 | 141–251 | 163–176 | 192–198 | 231–240 | 1–125 | 26–35 | 50–66 | 99–114 | DFYDILTGYPLGGMDV (SEQ ID NO: 2741) |
| I007E11 | 952 | 144–251 | 165–175 | 191–197 | 230–240 | 1–128 | 26–35 | 50–66 | 99–117 | DLPYYDILTGYSLTSGMDV (SEQ ID NO: 2923) |
| I007F06 | 953 | 141–248 | 162–172 | 188–194 | 227–237 | 1–125 | 26–35 | 50–66 | 99–114 | ATYDPLTGYSFDGFDI (SEQ ID NO: 2153) |
| I007F08 | 954 | 143–253 | 165–178 | 194–200 | 233–242 | 1–127 | 26–35 | 50–65 | 98–116 | GRRYDILTGYYYYHHGMDV (SEQ ID NO: 2811) |
| I007G07 | 955 | 141–251 | 163–176 | 192–198 | 231–240 | 1–125 | 26–35 | 50–66 | 99–114 | SHYDILTGLNYWYFDL (SEQ ID NO: 2166) |
| I007G09 | 956 | 142–252 | 164–177 | 193–199 | 232–241 | 1–126 | 26–35 | 50–66 | 99–115 | DSGGDILTGYYMPYFDY (SEQ ID NO: 2847) |
| I007G10 | 957 | 142–249 | 163–173 | 189–195 | 228–238 | 1–126 | 26–35 | 50–65 | 98–115 | VGLYYDILTGYYPSGMDV (SEQ ID NO: 2805) |
| I007H07 | 958 | 147–257 | 169–182 | 198–204 | 237–246 | 1–131 | 26–35 | 50–68 | 101–120 | SQAHYDILTGYYLWSYGMDV (SEQ ID NO: 2875) |
| I007H11 | 959 | 141–248 | 162–172 | 188–194 | 227–237 | 1–125 | 26–35 | 50–66 | 99–114 | ESYDILTGYRHYGMDL (SEQ ID NO: 2891) |
| I008A02 | 960 | 141–251 | 163–176 | 192–198 | 231–240 | 1–125 | 26–35 | 50–66 | 99–114 | ATYDPLTGYSFDGFDI (SEQ ID NO: 2153) |
| I008A05 | 961 | 141–251 | 163–176 | 192–198 | 231–240 | 1–125 | 26–35 | 50–66 | 99–114 | ATYDPLTGYSFDGFDI (SEQ ID NO: 2153) |
| I008A06 | 962 | 141–251 | 163–176 | 192–198 | 231–240 | 1–125 | 26–35 | 50–66 | 99–114 | ATYDPLTGYSFDGFDI (SEQ ID NO: 2153) |
| I008A07 | 963 | 142–249 | 163–173 | 189–195 | 228–238 | 1–126 | 26–35 | 50–66 | 99–115 | DREYDLLTGYYLHAFDM (SEQ ID NO: 2960) |
| I008A12 | 964 | 140–250 | 162–175 | 191–197 | 230–239 | 1–124 | 26–35 | 50–66 | 99–113 | ENYDFLTGYYGAFDI (SEQ ID NO: 2772) |
| I008B02 | 965 | 141–248 | 162–172 | 188–194 | 227–237 | 1–125 | 26–35 | 50–66 | 99–114 | ATYDPLTGYSFDGFDI (SEQ ID NO: 2153) |
| I008B04 | 966 | 143–253 | 165–178 | 194–200 | 233–242 | 1–127 | 26–35 | 50–66 | 99–116 | DGSYDILTGYYIDNYMDV (SEQ ID NO: 2154) |
| I008B05 | 967 | 141–248 | 162–172 | 188–194 | 227–237 | 1–125 | 26–35 | 50–66 | 99–114 | DHYDILTGLYYYGMDV (SEQ ID NO: 2760) |
| I008B06 | 968 | 141–251 | 163–176 | 192–198 | 231–240 | 1–125 | 26–35 | 50–66 | 99–114 | ATYDPLTGYSFDGFDI (SEQ ID NO: 2153) |
| I008B07 | 969 | 140–247 | 163–173 | 189–195 | 228–236 | 1–124 | 24–33 | 48–64 | 97–113 | GRRYDILTGYYKGPLDY (SEQ ID NO: 2902) |
| I008B10 | 970 | 141–248 | 162–172 | 188–194 | 227–237 | 1–125 | 26–35 | 50–66 | 99–114 | AYYDNLTGFLPYGMGV (SEQ ID NO: 2947) |
| I008B11 | 971 | 144–254 | 166–179 | 195–201 | 234–243 | 1–128 | 26–35 | 50–66 | 99–117 | EGYDILTGYFLDYYHGMDV (SEQ ID NO: 2753) |
| I008C06 | 972 | 141–251 | 163–176 | 192–198 | 231–240 | 1–125 | 26–35 | 50–66 | 99–114 | ATYDPLTGYSFDGFDI (SEQ ID NO: 2153) |
| I008C08 | 973 | 149–259 | 171–183 | 199–205 | 238–248 | 1–133 | 26–35 | 50–66 | 99–122 | GPRGGPYYDILTGYYLSLSDAFDI (SEQ ID NO: 2729) |
| I008C09 | 974 | 142–249 | 163–173 | 189–195 | 228–238 | 1–126 | 26–35 | 50–66 | 99–115 | EYYDILTGYRDPYGMDV (SEQ ID NO: 2973) |
| I008D01 | 975 | 141–251 | 163–176 | 192–198 | 231–240 | 1–125 | 26–35 | 50–66 | 99–114 | ATYDPLTGYSFDGFDI (SEQ ID NO: 2153) |
| I008D02 | 976 | 141–251 | 163–176 | 192–198 | 231–240 | 1–125 | 26–35 | 50–66 | 99–114 | ATYDPLTGYSFDGFDI (SEQ ID NO: 2153) |
| I008D03 | 977 | 144–254 | 166–179 | 195–201 | 234–243 | 1–128 | 26–35 | 50–66 | 99–117 | EVRNYDLLTRSYLAGPLDN (SEQ ID NO: 2751) |
| I008D04 | 978 | 141–251 | 163–176 | 192–198 | 231–240 | 1–125 | 26–35 | 50–66 | 99–114 | ATYDPLTGYSFDGFDI (SEQ ID NO: 2153) |
| I008D05 | 979 | 141–251 | 163–176 | 192–198 | 231–240 | 1–125 | 26–35 | 50–66 | 99–114 | ATYDPLTGYSFDGFDI (SEQ ID NO: 2153) |
| I008D06 | 980 | 141–248 | 162–172 | 188–194 | 227–237 | 1–125 | 26–35 | 50–66 | 99–114 | ATYDPLTGYSFDGFDI (SEQ ID NO: 2153) |
| I008D07 | 981 | 144–254 | 166–179 | 195–201 | 234–243 | 1–128 | 26–35 | 50–66 | 99–117 | DRGYYDILTGYYRGHGMDV (SEQ ID NO: 2837) |
| I008D08 | 982 | 144–251 | 165–175 | 191–197 | 230–240 | 1–128 | 26–35 | 50–66 | 99–117 | DLPYYDILTGYSLTSGMDV (SEQ ID NO: 2923) |
| I008D12 | 983 | 144–254 | 166–179 | 195–201 | 234–243 | 1–128 | 26–35 | 50–66 | 99–117 | EEGFYDILTGYYGPGYFDY (SEQ ID NO: 2974) |
| I008E01 | 984 | 141–248 | 162–172 | 188–194 | 227–237 | 1–125 | 26–35 | 50–66 | 99–114 | ATYDPLTGYSFDGFDI (SEQ ID NO: 2153) |
| I008E02 | 985 | 137–247 | 159–172 | 188–194 | 227–236 | 1–121 | 20–31 | 46–63 | 96–110 | EGYDILTGYSKFLDY (SEQ ID NO: 2906) |
| I008E03 | 986 | 141–251 | 163–176 | 192–198 | 231–240 | 1–125 | 26–35 | 50–66 | 99–114 | ATYDPLTGYSFDGFDI (SEQ ID NO: 2153) |

TABLE 1-continued scFvs that Immunospecifically Bind to BLyS

| Clone ID | scFv SEQ ID NO | AAs of VL | AAs of VL CDR1 | AAs of VL CDR2 | AAs of VL CDR3 | AAs of VH | AAs of VH CDR1 | AAs of VH CDR2 | AAs of VH CDR3 | VH CDR3 Sequence (SEQ ID NO) |
|---|---|---|---|---|---|---|---|---|---|---|
| I008E04 | 987 | 141–248 | 162–172 | 188–194 | 227–237 | 1–125 | 26–35 | 50–66 | 99–114 | ATYDPLTGYSFDGFDI (SEQ ID NO: 2153) |
| I008E08 | 988 | 141–252 | 163–175 | 191–197 | 230–241 | 1–125 | 26–35 | 50–66 | 99–114 | SHYDILTGLNYWYFDL (SEQ ID NO: 2166) |
| I008E09 | 989 | 143–253 | 165–178 | 194–200 | 233–242 | 1–127 | 26–35 | 50–66 | 99–116 | ERADYDILTGYYFYDMDV (SEQ ID NO: 2833) |
| I008E12 | 990 | 141–251 | 163–176 | 192–198 | 231–240 | 1–125 | 26–37 | 52–67 | 100–114 | FRYDILTSYYYGMDV (SEQ ID NO: 2734) |
| I008F03 | 991 | 141–251 | 163–176 | 192–198 | 231–240 | 1–125 | 26–35 | 50–66 | 99–114 | ATYDPLTGYSFDGFDI (SEQ ID NO: 2153) |
| I008F06 | 992 | 141–251 | 163–176 | 192–198 | 231–240 | 1–125 | 26–35 | 50–66 | 99–114 | ATYDPLTGYSFDGFDI (SEQ ID NO: 2153) |
| I008F07 | 993 | 143–250 | 164–174 | 190–196 | 229–239 | 1–127 | 26–35 | 50–65 | 98–116 | GRRYDILTGYYYYHHGMDV (SEQ ID NO: 2811) |
| I008F08 | 994 | 143–253 | 165–178 | 194–200 | 233–242 | 1–127 | 26–35 | 50–66 | 99–116 | GHYDILTGYDDYYYGMDV (SEQ ID NO: 2844) |
| I008F09 | 995 | 133–243 | 155–168 | 184–190 | 223–232 | 1–117 | 26–35 | 50–65 | 98–106 | HDILTGFDY (SEQ ID NO: 2904) |
| I008F10 | 996 | 140–247 | 161–171 | 187–193 | 226–236 | 1–124 | 26–35 | 50–66 | 99–113 | SGYDILTGYLYGMDV (SEQ ID NO: 2934) |
| I008F11 | 997 | 144–251 | 165–175 | 191–197 | 230–240 | 1–128 | 26–35 | 50–68 | 101–117 | APYDILTGYSDYYGMDV (SEQ ID NO: 2968) |
| I008G02 | 998 | 141–251 | 163–176 | 192–198 | 231–240 | 1–125 | 26–35 | 50–66 | 99–114 | ATYDPLTGYSFDGFDI (SEQ ID NO: 2153) |
| I008G03 | 999 | 140–247 | 161–171 | 187–193 | 226–236 | 1–124 | 26–35 | 50–66 | 99–113 | GDYDPLTGYSFGVDV (SEQ ID NO: 2941) |
| I008G04 | 1000 | 143–253 | 165–178 | 194–200 | 233–242 | 1–127 | 26–35 | 50–65 | 98–116 | EGSYDILTGYYVGVGRMDV (SEQ ID NO: 2171) |
| I008G05 | 1001 | 144–254 | 166–179 | 195–201 | 234–243 | 1–128 | 26–35 | 50–66 | 99–117 | DGYYDILTGGFYYYYGMDV (SEQ ID NO: 2899) |
| I008G11 | 1002 | 136–246 | 158–171 | 187–193 | 226–235 | 1–120 | 26–35 | 50–66 | 99–109 | AYYDILTGLDY (SEQ ID NO: 2966) |
| I008G12 | 1003 | 143–253 | 165–178 | 194–200 | 233–242 | 1–127 | 26–35 | 50–66 | 99–116 | DQQYDILTGYYIHYGMDV (SEQ ID NO: 2964) |
| I008H02 | 1004 | 141–248 | 164–174 | 190–196 | 229–237 | 1–125 | 26–35 | 50–66 | 99–114 | DQVDLLLMDHNYYMDV (SEQ ID NO: 2918) |
| I008H03 | 1005 | 141–251 | 163–176 | 192–198 | 231–240 | 1–125 | 26–35 | 50–66 | 99–114 | ATYDPLTGYSFDGFDI (SEQ ID NO: 2153) |
| I008H06 | 1006 | 143–253 | 165–178 | 194–200 | 233–242 | 1–127 | 26–35 | 50–65 | 98–116 | EGSYDILTGYYVGVGRMDV (SEQ ID NO: 2171) |
| I008H09 | 1007 | 143–253 | 165–178 | 194–200 | 233–242 | 1–127 | 26–35 | 50–66 | 99–116 | DQQYDILTGYYIHYGMDV (SEQ ID NO: 2964) |
| I008H11 | 1008 | 141–248 | 164–174 | 190–196 | 229–237 | 1–125 | 26–35 | 50–66 | 99–114 | TKYDILTGYYYYYMDV (SEQ ID NO: 2856) |
| I012B03 | 1009 | 140–249 | 163–175 | 191–197 | 230–238 | 1–124 | 26–34 | 49–65 | 98–113 | ELGLSIVGATTGALDM (SEQ ID NO: 2174) |
| I012B06 | 1010 | 140–251 | 163–176 | 192–198 | 231–240 | 1–124 | 26–34 | 49–65 | 98–113 | ELGLSIVGATTGALDM (SEQ ID NO: 2174) |
| I012B10 | 1011 | 140–251 | 163–175 | 191–197 | 230–240 | 1–124 | 26–34 | 49–65 | 98–113 | ELGLSIVGATTGALDM (SEQ ID NO: 2174) |
| I012C03 | 1012 | 142–255 | 165–178 | 194–200 | 233–244 | 1–126 | 26–35 | 50–66 | 99–115 | TDRFGAKDVTSRWGMDV (SEQ ID NO: 2814) |
| 1012C06 | 1013 | 140–251 | 163–176 | 192–198 | 231–240 | 1–124 | 26–34 | 49–65 | 98–113 | ELGLSIVGATTGALDM (SEQ ID NO: 2174) |
| I012C09 | 1014 | 140–250 | 164–174 | 190–196 | 229–239 | 1–124 | 26–34 | 49–65 | 98–113 | ELGLSIVGATTGALDM (SEQ ID NO: 2174) |
| I012D12 | 1015 | 145–256 | 168–180 | 196–202 | 235–245 | 1–129 | 26–35 | 50–66 | 99–118 | DRGGNYDILTGYYFHHGVDV (SEQ ID NO: 2914) |
| I012E07 | 1016 | 140–252 | 164–176 | 192–198 | 231–241 | 1–124 | 26–34 | 49–65 | 98–113 | ELGLSIVGATTGALDM (SEQ ID NO: 2174) |
| I012E08 | 1017 | 139–250 | 162–174 | 190–196 | 229–239 | 1–123 | 26–35 | 50–66 | 99–112 | RYGDPFYYYYYMNV (SEQ ID NO: 2755) |
| I012E09 | 1018 | 140–247 | 163–173 | 189–195 | 228–236 | 1–124 | 26–34 | 49–65 | 98–113 | ELGLSIVGATTGALDM (SEQ ID NO: 2174) |
| I012F05 | 1019 | 140–249 | 163–173 | 189–195 | 228–238 | 1–124 | 26–34 | 49–65 | 98–113 | ELGLSIVGATTGALDM (SEQ ID NO: 2174) |
| I012F12 | 1020 | 140–251 | 164–176 | 192–198 | 231–240 | 1–124 | 26–34 | 49–65 | 98–113 | ELGLSIVGATTGALDM (SEQ ID NO: 2174) |
| I012G03 | 1021 | 140–252 | 164–176 | 192–198 | 231–241 | 1–124 | 26–34 | 49–65 | 98–113 | ELGLSIVGATTGALDM (SEQ ID NO: 2174) |
| I012G05 | 1022 | 139–250 | 163–173 | 189–195 | 228–239 | 1–123 | 26–35 | 50–66 | 99–112 | RYGDPFYYYYYMNV (SEQ ID NO: 2755) |
| I012G10 | 1023 | 139–251 | 162–175 | 191–197 | 230–240 | 1–123 | 26–35 | 50–66 | 99–112 | RYGDPFYYYYYMNV (SEQ ID NO: 2755) |
| I012H09 | 1024 | 140–249 | 163–173 | 189–195 | 228–238 | 1–124 | 26–34 | 49–65 | 98–113 | ELGLSIVGATTGALDM (SEQ ID NO: 2174) |
| I013A10 | 1025 | 147–259 | 170–182 | 198–204 | 237–248 | 1–131 | 26–35 | 50–66 | 99–120 | SSPPKWYDALTGHSSYHSAMDV (SEQ ID NO: 2159) |
| I013A12 | 1026 | 147–256 | 171–181 | 197–203 | 236–245 | 1–131 | 26–35 | 50–66 | 99–120 | SSPPKWYDALTGHSSYHSAMDV (SEQ ID NO: 2159) |
| I013B04 | 1027 | 147–256 | 172–182 | 198–204 | 237–245 | 1–131 | 26–35 | 50–66 | 99–120 | SSPPKWYDALTGDSSYHSAMDV (SEQ ID NO: 2165) |
| I013B09 | 1028 | 147–257 | 171–181 | 197–203 | 236–246 | 1–131 | 26–35 | 50–66 | 99–120 | SSPPKWYDALTGHSSYHSAMDV (SEQ ID NO: 2159) |
| I013C02 | 1029 | 147–258 | 170–182 | 198–204 | 237–247 | 1–131 | 26–35 | 50–66 | 99–120 | SSPPKWYDALTGDSSYRSAMDV (SEQ ID NO: 2818) |
| I013G04 | 1030 | 137–249 | 161–173 | 189–195 | 228–238 | 1–121 | 26–35 | 50–66 | 99–110 | GYDSSAFRAFDI (SEQ ID NO: 2136) |
| I013D02 | 1031 | 137–248 | 160–173 | 189–195 | 228–237 | 1–121 | 26–35 | 50–66 | 99–110 | GYDSSAFRAFDI (SEQ ID NO: 2136) |
| I013D03 | 1032 | 147–259 | 170–183 | 199–205 | 238–248 | 1–131 | 26–35 | 50–66 | 99–120 | SSPPKWYDALTGDSSYHSAMDV (SEQ ID NO: 2165) |
| I013D10 | 1033 | 145–257 | 168–181 | 197–203 | 236–246 | 1–129 | 26–35 | 50–66 | 99–118 | GLRHVTLFGTGTRGHFYMDV (SEQ ID NO: 2789) |

TABLE 1-continued scFvs that Immunospecifically Bind to BLyS

| Clone ID | scFv SEQ ID NO | AAs of VL | AAs of VL CDR1 | AAs of VL CDR2 | AAs of VL CDR3 | AAs of VH | AAs of VH CDR1 | AAs of VH CDR2 | AAs of VH CDR3 | VH CDR3 Sequence (SEQ ID NO) |
|---|---|---|---|---|---|---|---|---|---|---|
| I013E02 | 1034 | 147–259 | 170–183 | 199–205 | 238–248 | 1–131 | 26–35 | 50–66 | 99–120 | GREDTDKVKPWDRYYHYYYMDV (SEQ ID NO: 2809) |
| I013E05 | 1035 | 137–249 | 162–173 | 189–195 | 228–238 | 1–121 | 26–35 | 50–66 | 99–110 | GYDSSAFRAFDI (SEQ ID NO: 2136) |
| I013E09 | 1036 | 147–260 | 170–183 | 199–205 | 238–249 | 1–131 | 26–35 | 50–66 | 99–120 | SSPPKWYDALTGDSSYHSAMDV (SEQ ID NO: 2165) |
| I013F03 | 1037 | 137–248 | 160–172 | 188–194 | 227–237 | 1–121 | 26–35 | 50–66 | 99–110 | GYDSSAFRAFDI (SEQ ID NO: 2136) |
| I013F04 | 1038 | 147–258 | 170–182 | 198–204 | 237–247 | 1–131 | 26–35 | 50–66 | 99–120 | SSPPKWYDALTGHSSYHSAMDV (SEQ ID NO: 2159) |
| I013F07 | 1039 | 145–260 | 170–185 | 201–207 | 240–249 | 1–129 | 26–35 | 50–66 | 99–118 | AATTSQKHNKYAYYFYGMDV (SEQ ID NO: 2131) |
| I013F09 | 1040 | 137–248 | 160–172 | 188–194 | 227–237 | 1–121 | 26–35 | 50–66 | 99–110 | GYDSSAFRAFDI (SEQ ID NO: 2136) |
| I013F10 | 1041 | 147–259 | 170–183 | 199–205 | 238–248 | 1–131 | 26–35 | 50–66 | 99–120 | SSPPKWYDALTGHSSYHSAMDV (SEQ ID NO: 2159) |
| I013H04 | 1042 | 147–258 | 170–182 | 198–204 | 237–247 | 1–131 | 26–35 | 50–66 | 99–120 | SSPPKWYDALTGHSSYHSAMDV (SEQ ID NO: 2159) |
| I013H07 | 1043 | 147–259 | 170–183 | 199–205 | 238–248 | 1–131 | 26–35 | 50–66 | 99–120 | GREDTDKVKPWDRYYHYYYMDV (SEQ ID NO: 2809) |
| I014A12 | 1044 | 143–253 | 165–178 | 194–200 | 233–242 | 1–127 | 24–33 | 48–64 | 97–116 | EGGNYDILTGYYIGNGAFDI (SEQ ID NO: 2158) |
| I014C06 | 1045 | 141–254 | 164–177 | 193–200 | 233–243 | 1–125 | 26–35 | 50–66 | 99–114 | GDYDILTGYPAECFQI (SEQ ID NO: 2854) |
| I014C10 | 1046 | 141–251 | 163–176 | 192–198 | 231–240 | 1–125 | 26–35 | 50–66 | 99–114 | ATYDPLTGYSFDGFDI (SEQ ID NO: 2153) |
| I014C12 | 1047 | 141–251 | 163–176 | 192–198 | 231–240 | 1–125 | 26–35 | 50–66 | 99–114 | ATYDPLTGYSFDGFDI (SEQ ID NO: 2153) |
| I014E06 | 1048 | 140–252 | 164–176 | 192–198 | 231–241 | 1–124 | 26–34 | 49–65 | 98–113 | ELGLSIVGATTGALDM (SEQ ID NO: 2174) |
| I014F02 | 1049 | 141–251 | 166–176 | 192–198 | 231–240 | 1–125 | 26–37 | 52–67 | 100–114 | AGYDLLTGYPFYFDS (SEQ ID NO: 2757) |
| I016A08 | 1050 | 144–251 | 165–175 | 191–197 | 230–240 | 1–128 | 26–35 | 50–66 | 99–117 | EVRNYDLLTRSYLAGPLDN (SEQ ID NO: 2751) |
| I016A09 | 1051 | 141–251 | 163–176 | 192–198 | 231–240 | 1–125 | 26–35 | 50–66 | 99–114 | ATYDPLTGYSFDGFDI (SEQ ID NO: 2153) |
| I016C02 | 1052 | 141–251 | 163–176 | 192–198 | 231–240 | 1–125 | 26–35 | 50–66 | 99–114 | ATYDPLTGYSFDGFDI (SEQ ID NO: 2153) |
| I016C03 | 1053 | 141–251 | 163–176 | 192–198 | 231–240 | 1–125 | 26–35 | 50–66 | 99–114 | ATYDPLTGYSFDGFDI (SEQ ID NO: 2153) |
| I016C05 | 1054 | 148–255 | 169–179 | 195–201 | 234–244 | 1–132 | 26–35 | 50–66 | 99–121 | VQMDSEYYDLLTGINVGPYYFDY (SEQ ID NO: 2132) |
| I016C09 | 1055 | 141–251 | 163–176 | 192–198 | 231–240 | 1–125 | 26–35 | 50–66 | 99–114 | ATYDPLTGYSFDGFDI (SEQ ID NO: 2153) |
| I016C11 | 1056 | 148–255 | 169–179 | 195–201 | 234–244 | 1–132 | 26–35 | 50–66 | 99–121 | VQMDSEYYDLLTGINVGPYYFDY (SEQ ID NO: 2132) |
| IO16D10 | 1057 | 141–251 | 163–176 | 192–198 | 231–240 | 1–125 | 26–35 | 50–66 | 99–114 | ATYDPLTGYSFDGFDI (SEQ ID NO: 2153) |
| I016D11 | 1058 | 141–251 | 163–176 | 192–198 | 231–240 | 1–125 | 26–35 | 50–66 | 99–114 | ATYDPLTGYSFDGFDI (SEQ ID NO: 2153) |
| I016E03 | 1059 | 141–251 | 163–176 | 192–198 | 231–240 | 1–125 | 26–35 | 50–66 | 99–114 | ATYDPLTGYSFDGFDI (SEQ ID NO: 2153) |
| I016E04 | 1060 | 141–251 | 163–176 | 192–198 | 231–240 | 1–125 | 26–35 | 50–66 | 99–114 | ATYDPLTGYSFDGFDI (SEQ ID NO: 2153) |
| I016F03 | 1061 | 141–251 | 163–176 | 192–198 | 231–240 | 1–125 | 26–35 | 50–66 | 99–114 | ATYDPLTGYSFDGFDI (SEQ ID NO: 2153) |
| I016F11 | 1062 | 141–251 | 163–176 | 192–198 | 231–240 | 1–125 | 26–35 | 50–66 | 99–114 | ATYDPLTGYSFDGFDI (SEQ ID NO: 2153) |
| I016G01 | 1063 | 141–251 | 163–176 | 192–198 | 231–240 | 1–125 | 26–35 | 50–66 | 99–114 | ATYDPLTGYSFDGFDI (SEQ ID NO: 2153) |
| I016G06 | 1064 | 141–251 | 163–176 | 192–198 | 231–240 | 1–125 | 26–35 | 50–66 | 99–114 | ATYDPLTGYSFDGFDI (SEQ ID NO: 2153) |
| I016G12 | 1065 | 148–255 | 169–179 | 195–201 | 234–244 | 1–132 | 26–35 | 50–66 | 99–121 | VQMDSEYYDLLTGINVGPYYFDY (SEQ ID NO: 2132) |
| I016H10 | 1066 | 141–251 | 163–176 | 192–198 | 231–240 | 1–125 | 26–35 | 50–66 | 99–114 | ATYDPLTGYSFDGFDI (SEQ ID NO: 2153) |
| I017A06 | 1067 | 141–251 | 163–176 | 192–198 | 231–240 | 1–125 | 26–35 | 50–66 | 99–114 | ATYDPLTGYSFDGFDI (SEQ ID NO: 2153) |
| I017A07 | 1068 | 141–251 | 163–176 | 192–198 | 231–240 | 1–125 | 26–35 | 50–66 | 99–114 | ATYDPLTGYSFDGFDI (SEQ ID NO: 2153) |
| I017A11 | 1069 | 140–253 | 162–175 | 191–197 | 233–242 | 1–124 | 25–34 | 49–65 | 98–113 | ATYDPLTGYSFDGLDI (SEQ ID NO: 2157) |
| I017E12 | 1070 | 141–251 | 163–176 | 192–198 | 231–240 | 1–125 | 26–35 | 50–66 | 99–114 | ATYDPLTGYSFDGFDI (SEQ ID NO: 2153) |
| I017G03 | 1071 | 141–251 | 163–176 | 192–198 | 231–240 | 1–125 | 26–35 | 50–66 | 99–114 | ATYDPLTGYSFDGFDI (SEQ ID NO: 2153) |
| I017G07 | 1072 | 141–251 | 163–176 | 192–198 | 231–240 | 1–125 | 26–35 | 50–66 | 99–114 | ATYDPLTGYSFDGFDI (SEQ ID NO: 2153) |
| I017H01 | 1073 | 141–251 | 163–176 | 192–198 | 231–240 | 1–125 | 26–35 | 50–66 | 99–114 | ATYDPLTGYSFDGFDI (SEQ ID NO: 2153) |
| I018A02 | 1074 | 141–251 | 163–176 | 192–198 | 231–240 | 1–125 | 26–35 | 50–66 | 99–114 | ATYDPLTGYSFDGFDI (SEQ ID NO: 2153) |
| I018A04 | 1075 | 144–254 | 166–179 | 195–201 | 234–243 | 1–128 | 26–35 | 50–66 | 99–117 | EGSYDILTGYYVGVGRMDV (SEQ ID NO: 2171) |
| I018A05 | 1076 | 141–251 | 163–176 | 192–198 | 231–240 | 1–125 | 26–35 | 50–66 | 99–114 | ATYDPLTGYSFDGFDI (SEQ ID NO: 2153) |
| I018A11 | 1077 | 141–251 | 163–176 | 192–198 | 231–240 | 1–125 | 26–35 | 50–66 | 99–114 | ATYDPLTGYSFDGFDI (SEQ ID NO: 2153) |
| I018B02 | 1078 | 141–251 | 163–176 | 192–198 | 231–240 | 1–125 | 26–35 | 50–66 | 99–114 | ATYDPLTGYSFDGFDI (SEQ ID NO: 2153) |
| I018B08 | 1079 | 141–251 | 163–176 | 192–198 | 231–240 | 1–125 | 26–35 | 50–66 | 99–114 | ATYDPLTGYSFDGFDI (SEQ ID NO: 2153) |
| I018C04 | 1080 | 141–251 | 163–176 | 192–198 | 231–240 | 1–125 | 26–35 | 50–66 | 99–114 | ATYDPLTGYSFDGFDI (SEQ ID NO: 2153) |

TABLE 1-continued scFvs that Immunospecifically Bind to BLyS

| Clone ID | scFv SEQ ID NO | AAs of VL | AAs of VL CDR1 | AAs of VL CDR2 | AAs of VL CDR3 | AAs of VH | AAs of VH CDR1 | AAs of VH CDR2 | AAs of VH CDR3 | VH CDR3 Sequence (SEQ ID NO) |
|---|---|---|---|---|---|---|---|---|---|---|
| I018D02 | 1081 | 141–251 | 163–176 | 192–198 | 231–240 | 1–125 | 26–35 | 50–66 | 99–114 | ATYDPLTGYSFDGFDI (SEQ ID NO: 2153) |
| I018E06 | 1082 | 141–251 | 163–176 | 192–198 | 231–240 | 1–125 | 26–35 | 50–66 | 99–114 | ATYDPLTGYSFDGFDI (SEQ ID NO: 2153) |
| I018E08 | 1083 | 141–251 | 163–176 | 192–198 | 231–240 | 1–125 | 26–35 | 50–66 | 99–114 | ATYDPLTGYSFDGFDI (SEQ ID NO: 2153) |
| I018F04 | 1084 | 141–251 | 163–176 | 192–198 | 231–240 | 1–125 | 26–35 | 50–66 | 99–114 | ATYDPLTGYSFDGFDI (SEQ ID NO: 2153) |
| I018G06 | 1085 | 141–251 | 163–176 | 192–198 | 231–240 | 1–125 | 26–35 | 50–66 | 99–114 | ATYDPLTGYSFDGFDI (SEQ ID NO: 2153) |
| I018H07 | 1086 | 141–251 | 163–176 | 192–198 | 231–240 | 1–125 | 26–35 | 50–66 | 99–114 | ATYDPLTGYSFDGFDI (SEQ ID NO: 2153) |
| I019E05 | 1087 | 144–254 | 166–179 | 195–201 | 234–243 | 1–128 | 26–35 | 50–66 | 99–117 | ERHYYDILTGYQTGYGMDV (SEQ ID NO: 2784) |
| I019F06 | 1088 | 144–254 | 166–179 | 195–201 | 234–243 | 1–128 | 26–35 | 50–66 | 99–117 | ERHYYDILTGYQTGYGMDV (SEQ ID NO: 2784) |
| I019G12 | 1089 | 143–253 | 165–178 | 194–200 | 233–242 | 1–127 | 24–33 | 48–64 | 97–116 | EGGNYDILTGYYIGNGAFDI (SEQ ID NO: 2158) |
| I020D01 | 1090 | 137–247 | 159–171 | 187–193 | 226–236 | 1–121 | 26–35 | 50–66 | 99–110 | DRETKVGYGMDV (SEQ ID NO: 2945) |
| I020D05 | 1091 | 143–253 | 165–178 | 194–200 | 233–242 | 1–127 | 24–33 | 48–64 | 97–116 | EGGNYDILTGYYIGNGAFDI (SEQ ID NO: 2158) |
| I020E10 | 1092 | 143–253 | 165–178 | 194–200 | 233–242 | 1–127 | 24–33 | 48–64 | 97–116 | EGGNYDILTGYYIGNGAFDI (SEQ ID NO: 2158) |
| I020G12 | 1093 | 143–253 | 165–178 | 194–200 | 233–242 | 1–127 | 24–33 | 48–64 | 97–116 | EGGNYDILTGYYIGNGAFDI (SEQ ID NO: 2158) |
| I020H06 | 1094 | 143–253 | 165–178 | 194–200 | 233–242 | 1–127 | 24–33 | 48–64 | 97–116 | EGGNYHILTGYYIGNGAFDI (SEQ ID NO: 2896) |
| I020H10 | 1095 | 143–253 | 165–178 | 194–200 | 233–242 | 1–127 | 24–33 | 48–64 | 97–116 | EGENYDILTGYYIGNGAFDI (SEQ ID NO: 2903) |
| I021A11 | 1096 | 143–253 | 165–178 | 194–200 | 233–242 | 1–127 | 24–33 | 48–64 | 97–116 | EGGNYDILTGYYIGNGAFDI (SEQ ID NO: 2158) |
| I021B01 | 1097 | 143–253 | 165–178 | 194–200 | 233–242 | 1–127 | 24–33 | 48–64 | 97–116 | EGGNYDILTGYYIGNGAFDI (SEQ ID NO: 2158) |
| I021C11 | 1098 | 143–253 | 165–178 | 194–200 | 233–242 | 1–127 | 24–33 | 48–64 | 97–116 | EGGNYDILTGYYIGNGAFDI (SEQ ID NO: 2158) |
| I021D12 | 1099 | 137–247 | 159–171 | 187–193 | 226–236 | 1–121 | 26–35 | 50–66 | 99–110 | DRETKVGYGMDV (SEQ ID NO: 2945) |
| I021E10 | 1100 | 143–253 | 165–178 | 194–200 | 233–242 | 1–127 | 24–33 | 48–64 | 97–116 | EGGNYDILTGYYIGNGAFDI (SEQ ID NO: 2158) |
| I021G02 | 1101 | 143–253 | 165–178 | 194–200 | 233–242 | 1–127 | 24–33 | 48–64 | 97–116 | EGGNYDILTGYYIGNGAFDI (SEQ ID NO: 2158) |
| I022A08 | 1102 | 142–249 | 163–173 | 189–195 | 228–238 | 1–126 | 26–35 | 50–66 | 99–115 | DGYYDILTGYSYYGMDV (SEQ ID NO: 2135) |
| I022B01 | 1103 | 141–251 | 163–176 | 192–198 | 231–240 | 1–125 | 26–35 | 50–66 | 99–114 | ATYDPLTGYSFDGFDI (SEQ ID NO: 2153) |
| I022B10 | 1104 | 141–248 | 164–174 | 190–196 | 229–237 | 1–125 | 26–35 | 50–66 | 99–114 | MEYDILTGYYGGYFDY (SEQ ID NO: 2179) |
| I022C02 | 1105 | 142–249 | 163–173 | 189–195 | 228–238 | 1–126 | 26–35 | 50–66 | 99–115 | DGYYDILTGYSYYGMDV (SEQ ID NO: 2135) |
| I022C04 | 1106 | 141–251 | 163–176 | 192–198 | 231–240 | 1–125 | 26–35 | 50–66 | 99–114 | ATYDPLTGYSFDGFDI (SEQ ID NO: 2153) |
| I022C08 | 1107 | 141–251 | 163–176 | 192–198 | 231–240 | 1–125 | 26–35 | 50–66 | 99–114 | ATYDPLTGYSFDGFDI (SEQ ID NO: 2153) |
| I022D06 | 1108 | 142–249 | 163–173 | 189–195 | 228–238 | 1–126 | 26–35 | 50–66 | 99–115 | DGYYDILTGYSYYGMDV (SEQ ID NO: 2135) |
| I022E08 | 1109 | 142–249 | 163–173 | 189–195 | 228–238 | 1–126 | 26–35 | 50–66 | 99–115 | ASYYDILTGYYKGAFDI (SEQ ID NO: 2855) |
| I022F01 | 1110 | 142–249 | 163–173 | 189–195 | 228–238 | 1–126 | 26–35 | 50–66 | 99–115 | DGYYDILTGYSYYGMDV (SEQ ID NO: 2135) |
| I022F04 | 1111 | 142–249 | 163–173 | 189–195 | 228–238 | 1–126 | 26–35 | 50–66 | 99–115 | DGYYDILTGYSYYGMDV (SEQ ID NO: 2135) |
| I022F12 | 1112 | 140–247 | 161–171 | 187–193 | 226–236 | 1–124 | 26–35 | 50–66 | 99–113 | GDYDILTGTYYYIDV (SEQ ID NO: 2859) |
| I022G11 | 1113 | 142–249 | 163–173 | 189–195 | 228–238 | 1–126 | 26–35 | 50–66 | 99–115 | DGYYDILTGYSYYGMDV (SEQ ID NO: 2135) |
| I023D01 | 1114 | 141–251 | 163–176 | 192–198 | 231–240 | 1–125 | 26–35 | 50–66 | 99–114 | SHYDILTGLNYWYFDL (SEQ ID NO: 2166) |
| I023D04 | 1115 | 142–249 | 163–173 | 189–195 | 228–238 | 1–126 | 26–35 | 50–66 | 99–115 | DGYYDILTGYSYYGMDV (SEQ ID NO: 2135) |
| I024B04 | 1116 | 140–247 | 161–171 | 187–193 | 226–236 | 1–124 | 26–35 | 50–66 | 99–113 | VYYDILTGYNLFFDY (SEQ ID NO: 2177) |
| I024D01 | 1117 | 142–249 | 163–173 | 189–195 | 228–238 | 1–126 | 26–35 | 50–66 | 99–115 | DGYYDILTGYSYYGMDV (SEQ ID NO: 2135) |
| I024F06 | 1118 | 142–249 | 163–173 | 189–195 | 228–238 | 1–126 | 26–35 | 50–66 | 99–115 | DGYYDILTGYSYYGMDV (SEQ ID NO: 2135) |
| I024H01 | 1119 | 142–249 | 163–173 | 189–195 | 228–238 | 1–126 | 26–35 | 50–66 | 99–115 | DGYYDILTGYSYYGMDV (SEQ ID NO: 2135) |
| I024H07 | 1120 | 142–249 | 163–173 | 189–195 | 228–238 | 1–126 | 26–35 | 50–66 | 99–115 | DGYYDILTGYSYYGMDV (SEQ ID NO: 2135) |
| I025A01 | 1121 | 140–251 | 163–176 | 192–198 | 231–240 | 1–124 | 26–34 | 49–65 | 98–113 | ELGSSIVGATTGALDM (SEQ ID NO: 2852) |
| I025A04 | 1122 | 140–251 | 163–175 | 191–197 | 230–240 | 1–124 | 26–34 | 49–65 | 98–113 | ELGLSIVGATTGALDM (SEQ ID NO: 2174) |
| I025A07 | 1123 | 140–249 | 163–173 | 189–195 | 228–238 | 1–124 | 26–34 | 49–65 | 98–113 | ELGLSIVGATTGALDM (SEQ ID NO: 2174) |
| I025B01 | 1124 | 133–244 | 156–168 | 184–190 | 223–233 | 1–117 | 26–35 | 50–66 | 99–106 | DQGRYLDL (SEQ ID NO: 2175) |
| I025B10 | 1125 | 140–253 | 164–176 | 192–198 | 233–242 | 1–124 | 26–35 | 50–66 | 99–113 | DNYDILTGYSRRFDP (SEQ ID NO: 2942) |
| I025B12 | 1126 | 140–251 | 163–176 | 192–198 | 231–240 | 1–124 | 26–34 | 49–65 | 98–113 | ELGSSIVGATTGALDM (SEQ ID NO: 2852) |
| I025C07 | 1127 | 140–251 | 163–176 | 192–198 | 231–240 | 1–124 | 26–34 | 49–65 | 98–113 | ELGSSIVGATTGALDM (SEQ ID NO: 2852) |

TABLE 1-continued scFvs that Immunospecifically Bind to BLyS

| Clone ID | scFv SEQ ID NO | AAs of VL | AAs of VL CDR1 | AAs of VL CDR2 | AAs of VL CDR3 | AAs of VH | AAs of VH CDR1 | AAs of VH CDR2 | AAs of VH CDR3 | VH CDR3 Sequence (SEQ ID NO) |
|---|---|---|---|---|---|---|---|---|---|---|
| I025D11 | 1128 | 140–252 | 164–176 | 192–198 | 231–241 | 1–124 | 26–34 | 49–65 | 98–113 | ELGLSIVGATTGALDM (SEQ ID NO: 2174) |
| I025E04 | 1129 | 142–252 | 164–176 | 192–198 | 231–241 | 1–126 | 26–35 | 50–66 | 99–115 | PLGITAVRGAKTDAFGI (SEQ ID NO: 2929) |
| I025E05 | 1130 | 140–251 | 163–175 | 191–197 | 230–240 | 1–124 | 26–34 | 49–65 | 98–113 | ELGLSIVGATTGALDM (SEQ ID NO: 2174) |
| I025E07 | 1131 | 140–252 | 164–176 | 192–198 | 231–241 | 1–124 | 26–34 | 49–65 | 98–113 | ELGLSIVGATTGALDM (SEQ ID NO: 2174) |
| I025E10 | 1132 | 141–251 | 163–176 | 192–198 | 231–240 | 1–125 | 26–35 | 50–66 | 99–114 | ATYDPLTGYSFDGFDI (SEQ ID NO: 2153) |
| I025F01 | 1133 | 139–251 | 162–175 | 191–197 | 230–240 | 1–123 | 26–35 | 50–66 | 99–112 | RYGDPFYYYYYMNV (SEQ ID NO: 2755) |
| I025F08 | 1134 | 137–248 | 160–172 | 188–194 | 227–237 | 1–121 | 26–35 | 50–66 | 99–110 | GGSSQNFYGMDV (SEQ ID NO: 2884) |
| I025G03 | 1135 | 140–252 | 164–176 | 192–198 | 231–241 | 1–124 | 26–34 | 49–65 | 98–113 | ELGLSIVGATTGALDM (SEQ ID NO: 2174) |
| I025G08 | 1136 | 140–254 | 163–176 | 192–198 | 231–243 | 1–124 | 26–34 | 49–65 | 98–113 | ELGLSIVGATTGALDM (SEQ ID NO: 2174) |
| I025H02 | 1137 | 144–255 | 167–179 | 195–201 | 234–244 | 1–128 | 26–35 | 50–65 | 98–117 | AGSGFHDILTGYYKGGYFDY (SEQ ID NO: 2961) |
| I026A01 | 1138 | 141–249 | 165–175 | 191–197 | 230–238 | 1–125 | 26–35 | 50–66 | 99–114 | GDYDILTGYPAECFQI (SEQ ID NO: 2854) |
| I026B01 | 1139 | 143–254 | 166–178 | 194–200 | 233–243 | 1–127 | 26–35 | 50–66 | 99–116 | GSVYDILTGTYYKSGMGV (SEQ ID NO: 2733) |
| I026B06 | 1140 | 140–251 | 163–176 | 192–198 | 231–240 | 1–124 | 26–34 | 49–65 | 98–113 | ELGSSIVGATTGALDM (SEQ ID NO: 2852) |
| I026C06 | 1141 | 140–251 | 163–176 | 192–198 | 231–240 | 1–124 | 26–34 | 49–65 | 98–113 | ELGSSIVGATTGALDM (SEQ ID NO: 2852) |
| I026C10 | 1142 | 138–249 | 161–174 | 190–196 | 229–238 | 1–122 | 26–34 | 49–65 | 98–111 | RYGDPFYYYYYMNV (SEQ ID NO: 2755) |
| I026C11 | 1143 | 141–251 | 163–176 | 192–198 | 231–240 | 1–125 | 26–35 | 50–66 | 99–114 | ATYDPLTGYSFDGFDI (SEQ ID NO: 2153) |
| I026D09 | 1144 | 139–252 | 162–175 | 191–197 | 230–241 | 1–123 | 26–35 | 50–66 | 99–112 | RYGDPFYYYYYMNV (SEQ ID NO: 2755) |
| I026E04 | 1145 | 140–252 | 164–176 | 192–198 | 231–241 | 1–124 | 26–34 | 49–65 | 98–113 | ELGLSIVGATTGALDM (SEQ ID NO: 2174) |
| I026E06 | 1146 | 140–251 | 163–175 | 191–197 | 230–240 | 1–124 | 26–35 | 50–66 | 99–113 | GYDDILTGYIMALDY (SEQ ID NO: 2821) |
| I026E09 | 1147 | 140–251 | 163–176 | 192–198 | 231–240 | 1–124 | 26–34 | 49–65 | 98–113 | ELGSSIVGATTGALDM (SEQ ID NO: 2852) |
| I026F01 | 1148 | 140–251 | 163–176 | 192–198 | 231–240 | 1–124 | 26–34 | 49–65 | 98–113 | ELGSSIVGATTGALDM (SEQ ID NO: 2852) |
| I026F09 | 1149 | 140–251 | 163–176 | 192–198 | 231–240 | 1–124 | 26–34 | 49–65 | 98–113 | ELGSSIVGATTGALDM (SEQ ID NO: 2852) |
| I026F12 | 1150 | 140–256 | 163–176 | 192–202 | 237–245 | 1–124 | 26–34 | 49–65 | 98–113 | ELGSSIVGATTGALDM (SEQ ID NO: 2852) |
| I026G08 | 1151 | 140–251 | 163–176 | 192–198 | 231–240 | 1–124 | 26–34 | 49–65 | 98–113 | ELGSSIVGATTGALDM (SEQ ID NO: 2852) |
| I026G10 | 1152 | 140–251 | 163–176 | 192–198 | 231–240 | 1–124 | 26–34 | 49–65 | 98–113 | ELGSSIVGATTGALDM (SEQ ID NO: 2852) |
| I026G11 | 1153 | 143–255 | 166–179 | 195–201 | 234–244 | 1–127 | 26–35 | 50–66 | 99–116 | GTGYDILTGYYMGSAFDQ (SEQ ID NO: 2800) |
| I026H02 | 1154 | 139–251 | 162–175 | 191–197 | 230–240 | 1–123 | 26–35 | 50–66 | 99–112 | RYGDPFYYYYYMNV (SEQ ID NO: 2755) |
| I026H06 | 1155 | 140–251 | 163–175 | 191–197 | 230–240 | 1–124 | 26–34 | 49–65 | 98–113 | ELGLSIVGATTGALDM (SEQ ID NO: 2174) |
| I026H10 | 1156 | 144–255 | 167–179 | 195–201 | 234–244 | 1–128 | 26–35 | 50–66 | 99–117 | GGEYDILTGYYFGLGVYDY (SEQ ID NO: 2170) |
| I027A09 | 1157 | 140–251 | 163–176 | 192–198 | 231–240 | 1–124 | 26–34 | 49–65 | 98–113 | ELGSSIVGATTGALDM (SEQ ID NO: 2852) |
| I027B02 | 1158 | 139–250 | 162–174 | 190–196 | 229–239 | 1–123 | 26–35 | 50–66 | 99–112 | RYGDPFYYYYYMNV (SEQ ID NO: 2755) |
| I027B05 | 1159 | 140–250 | 163–176 | 192–198 | 230–239 | 1–124 | 26–34 | 49–65 | 98–113 | ELGSSIVGATTGALDM (SEQ ID NO: 2852) |
| I027C08 | 1160 | 138–249 | 161–174 | 190–196 | 229–238 | 1–122 | 26–34 | 49–63 | 96–111 | ELGSSIVGATTGALDM (SEQ ID NO: 2852) |
| I027D02 | 1161 | 141–250 | 164–174 | 190–196 | 229–239 | 1–125 | 26–35 | 50–66 | 99–114 | DPFGAVPGYYYYAMDV (SEQ ID NO: 2826) |
| I027E03 | 1162 | 140–251 | 163–176 | 192–198 | 231–240 | 1–124 | 26–34 | 49–65 | 98–113 | ELGSSIVGATTGALDM (SEQ ID NO: 2852) |
| I027E05 | 1163 | 140–252 | 164–176 | 192–198 | 231–241 | 1–124 | 26–34 | 49–65 | 98–113 | ELGLSIVGATTGALDM (SEQ ID NO: 2174) |
| I027F04 | 1164 | 144–252 | 167–176 | 192–198 | 231–241 | 1–128 | 26–35 | 50–66 | 99–117 | GPWYDPLFPPSGRHYGLDV (SEQ ID NO: 2793) |
| I027F05 | 1165 | 140–254 | 163–176 | 192–198 | 231–243 | 1–124 | 26–34 | 49–65 | 98–113 | ELGLSIVGATTGALDM (SEQ ID NO: 2174) |
| I027F11 | 1166 | 140–251 | 163–176 | 192–198 | 231–240 | 1–124 | 26–34 | 49–65 | 98–113 | ELGSSIVGATTGALDM (SEQ ID NO: 2852) |
| I027G06 | 1167 | 140–253 | 164–176 | 192–198 | 233–242 | 1–124 | 26–35 | 50–66 | 99–113 | DNYDILTGYSRRFDP (SEQ ID NO: 2942) |
| I027G07 | 1168 | 140–250 | 164–174 | 190–196 | 229–239 | 1–124 | 26–34 | 49–65 | 98–113 | ELGLSIVGATTGALDM (SEQ ID NO: 2174) |
| I027H03 | 1169 | 141–252 | 164–176 | 192–198 | 231–241 | 1–125 | 26–35 | 50–66 | 99–114 | GDYDILTGYPAECFQI (SEQ ID NO: 2854) |
| I028A04 | 1170 | 143–250 | 164–174 | 190–196 | 229–239 | 1–127 | 26–35 | 50–66 | 99–116 | DMYYDILTGYYTGLAFDM (SEQ ID NO: 2880) |
| I028A07 | 1171 | 141–251 | 163–176 | 192–198 | 231–240 | 1–125 | 26–35 | 50–66 | 99–114 | VLNYDILTGYYYGMDV (SEQ ID NO: 2832) |
| I028B08 | 1172 | 141–251 | 163–176 | 192–198 | 231–240 | 1–125 | 26–35 | 50–66 | 99–114 | ATYDPLTGYSFDGFDI (SEQ ID NO: 2153) |
| I028B10 | 1173 | 148–258 | 170–183 | 199–205 | 238–247 | 1–132 | 26–35 | 50–68 | 101–121 | DFGYYDILTGYYIGAFYAFDI (SEQ ID NO: 2861) |
| I028C01 | 1174 | 142–250 | 165–175 | 191–197 | 230–239 | 1–126 | 26–37 | 52–69 | 102–115 | GGHTCIIPTCHMGG (SEQ ID NO: 2796) |

TABLE 1-continued scFvs that Immunospecifically Bind to BLyS

| Clone ID | scFv SEQ ID NO | AAs of VL | AAs of VL CDR1 | AAs of VL CDR2 | AAs of VL CDR3 | AAs of VH | AAs of VH CDR1 | AAs of VH CDR2 | AAs of VH CDR3 | VH CDR3 Sequence (SEQ ID NO) |
|---|---|---|---|---|---|---|---|---|---|---|
| I028C04 | 1175 | 143–253 | 165–178 | 194–200 | 233–242 | 1–127 | 26–35 | 50–66 | 99–116 | DMYYDILTGYYTGLAFDM (SEQ ID NO: 2880) |
| I028C08 | 1176 | 141–251 | 163–176 | 192–198 | 231–240 | 1–125 | 26–35 | 50–66 | 99–114 | ATYDPLTGYSFDGFDI (SEQ ID NO: 2153) |
| I028D04 | 1177 | 140–247 | 163–173 | 189–195 | 228–236 | 1–124 | 26–35 | 50–65 | 98–113 | ATQDILTGYLYSGMDV (SEQ ID NO: 2977) |
| I028D05 | 1178 | 141–248 | 162–172 | 188–194 | 227–237 | 1–125 | 26–35 | 50–66 | 99–114 | EHYDILTGYSLLGMDV (SEQ ID NO: 2907) |
| I028D12 | 1179 | 143–250 | 164–174 | 190–196 | 229–239 | 1–127 | 26–35 | 50–66 | 99–116 | DGYYDILTGYSVYYGMDV (SEQ ID NO: 2938) |
| I028E06 | 1180 | 143–253 | 165–178 | 194–200 | 233–242 | 1–127 | 26–35 | 50–65 | 98–116 | EGSYDILTGYYVGVGRMDV (SEQ ID NO: 2171) |
| I028E07 | 1181 | 141–248 | 162–172 | 188–194 | 227–237 | 1–125 | 26–35 | 50–66 | 99–114 | ATYDPLTGYSFDGFDI (SEQ ID NO: 2153) |
| I028E08 | 1182 | 141–248 | 162–172 | 188–194 | 227–237 | 1–125 | 26–35 | 50–66 | 99–114 | ATYDPLTGYSFDGFDI (SEQ ID NO: 2153) |
| I028F06 | 1183 | 146–256 | 168–180 | 196–202 | 235–245 | 1–130 | 26–35 | 50–66 | 99–119 | DDRRGYYDILTGYYRFGSFDI (SEQ ID NO: 2901) |
| I028F08 | 1184 | 134–244 | 156–169 | 185–191 | 224–233 | 1–118 | 26–35 | 50–66 | 99–107 | DIDIGGDDS (SEQ ID NO: 2954) |
| I028G08 | 1185 | 141–251 | 163–176 | 192–198 | 231–240 | 1–125 | 26–35 | 50–66 | 99–114 | VSGYNSGYFESYDMDV (SEQ ID NO: 2732) |
| I028G09 | 1186 | 144–254 | 166–179 | 195–201 | 234–243 | 1–128 | 26–35 | 50–66 | 99–117 | EVRNYDLLTRSYLAGPLDN (SEQ ID NO: 2751) |
| I028G10 | 1187 | 141–251 | 163–176 | 192–198 | 231–240 | 1–125 | 26–35 | 50–66 | 99–114 | ATYDPLTGYSFDGFDI (SEQ ID NO: 2153) |
| I028H02 | 1188 | 142–249 | 165–175 | 191–197 | 230–238 | 1–126 | 26–37 | 52–69 | 102–115 | SGEPCITLACNLGG (SEQ ID NO: 2797) |
| I028H03 | 1189 | 148–256 | 169–179 | 195–201 | 234–245 | 1–132 | 26–35 | 50–66 | 99–121 | DASEYYDILTGYYLATGRNWFDP (SEQ ID NO: 2888) |
| I028H06 | 1190 | 145–255 | 167–180 | 196–202 | 235–244 | 1–129 | 26–35 | 50–66 | 99–118 | DPSPYYDILTGYFLPYYMDV (SEQ ID NO: 2843) |
| I028H09 | 1191 | 140–250 | 162–175 | 191–197 | 230–239 | 1–124 | 26–35 | 50–68 | 101–113 | EIDDILTGYYMDV (SEQ ID NO: 2905) |
| I029A10 | 1192 | 139–246 | 160–170 | 186–192 | 225–235 | 1–123 | 26–35 | 50–65 | 98–112 | MNYDILTGLVNWFDP (SEQ ID NO: 2786) |
| I029A12 | 1193 | 137–247 | 159–171 | 187–193 | 226–236 | 1–121 | 26–35 | 50–68 | 101–110 | RDILTGFYDS (SEQ ID NO: 2933) |
| I029B11 | 1194 | 141–251 | 163–176 | 192–198 | 231–240 | 1–125 | 26–35 | 50–66 | 99–114 | ATYDPLTGYSFDGFDI (SEQ ID NO: 2153) |
| I029C08 | 1195 | 144–254 | 166–179 | 195–201 | 234–243 | 1–128 | 26–35 | 50–66 | 99–117 | EGSYDILTGYYVGVGRMDV (SEQ ID NO: 2171) |
| I029E10 | 1196 | 144–254 | 166–179 | 195–201 | 234–243 | 1–128 | 26–35 | 50–66 | 99–117 | EVRNYDLLTRSYLAGPLDN (SEQ ID NO: 2751) |
| I029F08 | 1197 | 144–254 | 166–179 | 195–201 | 234–243 | 1–128 | 26–35 | 50–66 | 99–117 | EVRNYDLLTRSYLAGPLDN (SEQ ID NO: 2751) |
| I029G08 | 1198 | 141–248 | 162–172 | 188–194 | 227–237 | 1–125 | 26–35 | 50–66 | 99–114 | GYYDILTGYQSDAFDI (SEQ ID NO: 2927) |
| I030A02 | 1199 | 142–253 | 165–177 | 193–199 | 232–242 | 1–126 | 26–35 | 50–66 | 99–115 | TERFGAKDVTARWGMDV (SEQ ID NO: 2874) |
| I030A03 | 1200 | 140–253 | 163–175 | 191–197 | 230–242 | 1–124 | 26–35 | 50–66 | 99–113 | ENYDILTGYYNFFDY (SEQ ID NO: 2737) |
| I030A04 | 1201 | 140–252 | 163–176 | 192–198 | 231–241 | 1–124 | 26–35 | 50–66 | 99–113 | RQYDILTGYYGGFDY (SEQ ID NO: 2958) |
| I030A05 | 1202 | 140–249 | 163–175 | 191–197 | 230–238 | 1–124 | 26–34 | 49–65 | 98–113 | ELGLSIVGATTGALDM (SEQ ID NO: 2174) |
| I030A09 | 1203 | 139–250 | 162–174 | 190–196 | 229–239 | 1–123 | 26–35 | 50–66 | 99–112 | RYGDPFYYYYYMNV (SEQ ID NO: 2755) |
| I030A12 | 1204 | 139–249 | 163–173 | 189–195 | 228–238 | 1–123 | 26–35 | 50–66 | 99–112 | RYGDPFYYYYYMNV (SEQ ID NO: 2755) |
| I030B06 | 1205 | 139–249 | 163–173 | 189–195 | 228–238 | 1–123 | 26–35 | 50–66 | 99–112 | RYGDPFYYYYYMNV (SEQ ID NO: 2755) |
| I030B08 | 1206 | 140–247 | 163–173 | 189–195 | 228–236 | 1–124 | 26–34 | 49–65 | 98–113 | ELGLSIVGATTGALDM SE ID NO: 2174) |
| I030B10 | 1207 | 141–251 | 165–175 | 191–197 | 230–240 | 1–125 | 26–35 | 50–66 | 99–114 | ELGHREGGYWYSPYNV (SEQ ID NO: 2838) |
| I030C03 | 1208 | 139–252 | 162–175 | 191–197 | 230–241 | 1–123 | 26–35 | 50–66 | 99–112 | RYGDPFYYYYYMNV (SEQ ID NO: 2755) |
| I030C06 | 1209 | 146–256 | 169–182 | 198–204 | 237–245 | 1–130 | 26–35 | 50–68 | 101–119 | DPGNYDILTGYYYYYGMDV (SEQ ID NO: 2935) |
| I030C08 | 1210 | 133–244 | 156–168 | 184–190 | 223–233 | 1–117 | 26–35 | 50–66 | 99–106 | SGPGWFDP (SEQ ID NO: 2870) |
| I030C09 | 1211 | 140–251 | 163–175 | 191–197 | 230–240 | 1–124 | 26–34 | 49–65 | 98–113 | ELGLSIVGATTGALDM (SEQ ID NO: 2174) |
| I030C10 | 1212 | 140–250 | 163–175 | 191–197 | 230–239 | 1–124 | 26–34 | 49–65 | 98–113 | ELGLSIVGATTGALDM (SEQ ID NO: 2174) |
| I030C11 | 1213 | 139–251 | 162–175 | 191–197 | 230–240 | 1–123 | 26–35 | 50–66 | 99–112 | RYGDPFYYYYYMNV (SEQ ID NO: 2755) |
| I030C12 | 1214 | 133–244 | 156–168 | 184–190 | 223–233 | 1–117 | 26–35 | 50–66 | 99–106 | SGPGWFDP (SEQ ID NO: 2870) |
| I030D07 | 1215 | 139–249 | 163–173 | 189–195 | 228–238 | 1–123 | 26–35 | 50–66 | 99–112 | RYGDPFYYYYYMNV (SEQ ID NO: 2755) |
| I030D12 | 1216 | 140–251 | 163–175 | 191–197 | 230–240 | 1–124 | 26–34 | 49–65 | 98–113 | ELGLSIVGATTGALDM (SEQ ID NO: 2174) |
| I030E02 | 1217 | 139–251 | 162–175 | 191–197 | 230–240 | 1–123 | 26–35 | 50–66 | 99–112 | RYGDPFYYYYYMNV (SEQ ID NO: 2755) |
| I030E05 | 1218 | 140–252 | 164–176 | 192–198 | 231–241 | 1–124 | 26–34 | 49–65 | 98–113 | ELGLSIVGATTGALDM (SEQ ID NO: 2174) |
| I030E07 | 1219 | 140–251 | 165–176 | 192–198 | 231–240 | 1–124 | 26–34 | 49–65 | 98–113 | ELGLSIVGATTGALDM (SEQ ID NO: 2174) |
| I030E08 | 1220 | 140–251 | 163–175 | 191–197 | 230–240 | 1–124 | 26–34 | 49–65 | 98–113 | ELGLSIVGATTGALDM (SEQ ID NO: 2174) |
| I030E09 | 1221 | 140–252 | 163–176 | 192–198 | 231–241 | 1–124 | 26–34 | 49–65 | 98–113 | ELGLSIVGATTGALDM (SEQ ID NO: 2174) |

TABLE 1-continued scFvs that Immunospecifically Bind to BLyS

| Clone ID | scFv SEQ ID NO | AAs of VL | AAs of VL CDR1 | AAs of VL CDR2 | AAs of VL CDR3 | AAs of VH | AAs of VH CDR1 | AAs of VH CDR2 | AAs of VH CDR3 | VH CDR3 Sequence (SEQ ID NO) |
|---|---|---|---|---|---|---|---|---|---|---|
| I030E10 | 1222 | 139–250 | 162–174 | 190–196 | 229–239 | 1–123 | 26–35 | 50–66 | 99–112 | RYGDPFYYYYYMNV (SEQ ID NO: 2755) |
| I030F02 | 1223 | 141–252 | 164–176 | 192–198 | 231–241 | 1–125 | 26–37 | 52–67 | 100–114 | AGYDLLTGYPFYFDS (SEQ ID NO: 2757) |
| I030F05 | 1224 | 140–251 | 163–175 | 191–197 | 230–240 | 1–124 | 26–34 | 49–65 | 98–113 | ELGLSIVGATTGALDM (SEQ ID NO: 2174) |
| I030F06 | 1225 | 139–251 | 162–175 | 191–197 | 230–240 | 1–123 | 26–35 | 50–66 | 99–112 | RYGDPFYYYYYMNV (SEQ ID NO: 2755) |
| I030F08 | 1226 | 140–254 | 163–176 | 192–198 | 231–243 | 1–124 | 26–34 | 49–65 | 98–113 | ELGLSIVGATTGALDM (SEQ ID NO: 2174) |
| I030F09 | 1227 | 140–253 | 164–176 | 192–198 | 231–242 | 1–124 | 26–34 | 49–65 | 98–113 | ELGLSIVGATTGALDM (SEQ ID NO: 2174) |
| I030F11 | 1228 | 139–250 | 162–174 | 190–196 | 229–239 | 1–123 | 26–35 | 50–66 | 99–112 | RYGDPFYYYYYMNV (SEQ ID NO: 2755) |
| I030F12 | 1229 | 140–251 | 163–175 | 191–197 | 230–240 | 1–124 | 26–35 | 50–66 | 99–113 | DNYDILTGYSRRFDP (SEQ ID NO: 2942) |
| I030G03 | 1230 | 140–256 | 163–176 | 192–202 | 237–245 | 1–124 | 26–34 | 49–65 | 98–113 | ELGLSIVGATTGALDM (SEQ ID NO: 2174) |
| I030G07 | 1231 | 139–251 | 162–175 | 191–197 | 230–240 | 1–123 | 26–35 | 50–66 | 99–112 | RYGDPFYYYYYMNV (SEQ ID NO: 2755) |
| I030G09 | 1232 | 140–251 | 164–174 | 190–196 | 229–240 | 1–124 | 26–34 | 49–65 | 98–113 | ELGLSIVGATTGALDM (SEQ ID NO: 2174) |
| I030H05 | 1233 | 145–255 | 168–181 | 197–203 | 236–244 | 1–129 | 26–35 | 50–66 | 99–118 | DRGGNYDILTGYYFHHGVDV (SEQ ID NO: 2914) |
| I030H06 | 1234 | 146–258 | 170–182 | 198–204 | 239–247 | 1–130 | 26–37 | 52–69 | 102–119 | ATKSYDILTRMYYYHMDV (SEQ ID NO: 2748) |
| I030H10 | 1235 | 140–253 | 163–176 | 192–198 | 231–242 | 1–124 | 26–35 | 50–66 | 99–113 | DNYDILTGYSRRFDP (SEQ ID NO: 2942) |
| I030H11 | 1236 | 140–252 | 164–176 | 192–198 | 231–241 | 1–124 | 26–34 | 49–65 | 98–113 | ELGLSIVGATTGALDM (SEQ ID NO: 2174) |
| I031A01 | 1237 | 137–248 | 160–173 | 189–195 | 228–237 | 1–121 | 26–35 | 50–66 | 99–110 | GYDSSAFRAFDI (SEQ ID NO: 2136) |
| I031A03 | 1238 | 141–251 | 166–176 | 192–198 | 231–240 | 1–125 | 26–35 | 50–66 | 99–114 | PYYDPLTAYTFQYFGN (SEQ ID NO: 2806) |
| I031A08 | 1239 | 147–258 | 170–182 | 198–204 | 237–247 | 1–131 | 26–35 | 50–66 | 99–120 | GREDTDKVKPWDRYYHYYYMDV (SEQ ID NO: 2809) |
| I031A12 | 1240 | 146–257 | 169–181 | 197–203 | 236–246 | 1–130 | 26–35 | 50–66 | 99–119 | GREDTDKVKPWDRYYHYYMDV (SEQ ID NO: 2972) |
| I031B03 | 1241 | 136–246 | 159–172 | 188–194 | 227–235 | 1–120 | 26–35 | 50–68 | 101–109 | GLGHTDSDS (SEQ ID NO: 2959) |
| I031B06 | 1242 | 142–253 | 165–177 | 193–199 | 232–242 | 1–126 | 26–35 | 50–66 | 99–115 | AKGYYYDSSGASDVFDV (SEQ ID NO: 2871) |
| I031B07 | 1243 | 147–258 | 170–182 | 198–204 | 237–247 | 1–131 | 26–35 | 50–66 | 99–120 | GREDTDKVKPWDRYYHYYYMDV (SEQ ID NO: 2809) |
| I031B08 | 1244 | 147–260 | 171–183 | 199–205 | 238–249 | 1–131 | 26–35 | 50–66 | 99–120 | SSPPKWYDALTGHSSYHSAMDV (SEQ ID NO: 2159) |
| I031B09 | 1245 | 147–258 | 170–182 | 198–204 | 237–247 | 1–131 | 26–35 | 50–66 | 99–120 | SNPPKWYDALTGHSSYHSAMDV (SEQ ID NO: 2840) |
| I031B11 | 1246 | 137–248 | 160–172 | 188–194 | 227–237 | 1–121 | 26–35 | 50–66 | 99–110 | GYDSSAFRAFDI (SEQ ID NO: 2136) |
| I031B12 | 1247 | 147–259 | 170–183 | 199–205 | 238–248 | 1–131 | 26–35 | 50–66 | 99–120 | GREDTDKVKPWDRYYHYYYMDV (SEQ ID NO: 2809) |
| I031C01 | 1248 | 137–248 | 160–172 | 188–194 | 227–237 | 1–121 | 26–35 | 50–66 | 99–110 | GYDSSAFRAFDI (SEQ ID NO: 2136) |
| I031C02 | 1249 | 141–253 | 164–177 | 193–199 | 232–242 | 1–125 | 26–35 | 50–66 | 99–114 | PFYDTLTSYVFQYFDH (SEQ ID NO: 2137) |
| I031C04 | 1250 | 147–260 | 171–183 | 199–205 | 238–249 | 1–131 | 26–35 | 50–66 | 99–120 | GRKDTDKVKPWDRYYHYYYMDV (SEQ ID NO: 2813) |
| I031C08 | 1251 | 137–248 | 161–171 | 187–193 | 226–237 | 1–121 | 26–35 | 50–66 | 99–110 | GYDSSAFRAFDI (SEQ ID NO: 2136) |
| I031C11 | 1252 | 147–257 | 171–181 | 197–203 | 236–246 | 1–131 | 26–35 | 50–66 | 99–120 | GREDTDKVKPWDRYYHYYYMDV (SEQ ID NO: 2809) |
| I031D01 | 1253 | 145–256 | 168–180 | 196–202 | 235–245 | 1–129 | 26–35 | 50–66 | 99–118 | AATTSQKHNKYAYYFYGMDV (SEQ ID NO: 2131) |
| I031D04 | 1254 | 137–248 | 160–172 | 188–194 | 227–237 | 1–121 | 26–35 | 50–66 | 99–110 | GYDSSAFRAFDI (SEQ ID NO: 2136) |
| I031D06 | 1255 | 147–258 | 170–182 | 198–204 | 237–247 | 1–131 | 26–35 | 50–66 | 99–120 | GREDTDKVKLWDRYYHYYYMDV (SEQ ID NO: 2807) |
| I031D08 | 1256 | 144–257 | 167–180 | 196–202 | 235–246 | 1–128 | 26–35 | 50–66 | 99–117 | VRPKLRYFDWLSRHDAFDL (SEQ ID NO: 2820) |
| I031D09 | 1257 | 137–247 | 161–171 | 187–193 | 226–236 | 1–121 | 26–35 | 50–66 | 99–110 | GYDSSAFRAFDI (SEQ ID NO: 2136) |
| I031D11 | 1258 | 147–256 | 171–181 | 197–203 | 236–245 | 1–131 | 26–35 | 50–66 | 99–120 | SSPPKWYDALTGDSSYHSAMDV (SEQ ID NO: 2165) |
| I031D12 | 1259 | 144–254 | 168–178 | 194–200 | 233–243 | 1–128 | 26–35 | 50–66 | 99–117 | DKAHGEYGRDYYYYYGMDV (SEQ ID NO: 2735) |
| I031E01 | 1260 | 147–258 | 170–182 | 198–204 | 237–247 | 1–131 | 26–35 | 50–66 | 99–120 | SSPPKWYDALTGHSSYHSAMDV (SEQ ID NO: 2159) |
| I031E05 | 1261 | 147–257 | 171–181 | 197–203 | 236–246 | 1–131 | 26–35 | 50–66 | 99–120 | SGPPKWYDALTGHSSYHSAMDV (SEQ ID NO: 2848) |
| I031E07 | 1262 | 147–259 | 170–182 | 198–204 | 237–248 | 1–131 | 26–35 | 50–66 | 99–120 | SSPPKWYDALTGHSSYHSAMDV (SEQ ID NO: 2159) |
| I031E08 | 1263 | 147–259 | 170–183 | 199–205 | 238–248 | 1–131 | 26–35 | 50–66 | 99–120 | GREDTDKVKPWDRYYHYYYMDV (SEQ ID NO: 2809) |
| I031E09 | 1264 | 137–246 | 162–173 | 189–195 | 228–235 | 1–121 | 26–35 | 50–66 | 99–110 | GYDSSAFRAFDI (SEQ ID NO: 2136) |
| I031E10 | 1265 | 147–258 | 170–182 | 198–204 | 237–247 | 1–131 | 26–35 | 50–66 | 99–120 | SSPPKWYDALTGDSSYHSAMDV (SEQ ID NO: 2165) |
| I031E11 | 1266 | 147–258 | 170–182 | 198–204 | 237–247 | 1–131 | 26–35 | 50–66 | 99–120 | SSPPKWYDALTGHSSYHSAMDV (SEQ ID NO: 2159) |
| I031F01 | 1267 | 137–248 | 160–172 | 188–194 | 227–237 | 1–121 | 26–35 | 50–66 | 99–110 | GYDSSAFRAFDI (SEQ ID NO: 2136) |
| I031F04 | 1268 | 137–246 | 162–172 | 188–194 | 227–235 | 1–121 | 26–35 | 50–66 | 99–110 | GYDSSAFRAFDI (SEQ ID NO: 2136) |

TABLE 1-continued scFvs that Immunospecifically Bind to BLyS

| Clone ID | scFv SEQ ID NO | AAs of VL | AAs of VL CDR1 | AAs of VL CDR2 | AAs of VL CDR3 | AAs of VH | AAs of VH CDR1 | AAs of VH CDR2 | AAs of VH CDR3 | VH CDR3 Sequence (SEQ ID NO) |
|---|---|---|---|---|---|---|---|---|---|---|
| I031F06 | 1269 | 135–247 | 159–171 | 187–193 | 226–236 | 1–119 | 26–35 | 50–66 | 99–108 | DTVRSGGMDV (SEQ ID NO: 2804) |
| I031F10 | 1270 | 147–259 | 170–183 | 199–205 | 238–248 | 1–131 | 26–35 | 50–66 | 99–120 | GREDTDKVKPWDRYYHYYYMDV (SEQ ID NO: 2809) |
| I031F11 | 1271 | 144–255 | 167–179 | 195–201 | 234–244 | 1–128 | 26–35 | 50–66 | 99–117 | DKAHGEYGRDYYYYYGMDV (SEQ ID NO: 2735) |
| I031F12 | 1272 | 137–249 | 160–172 | 188–194 | 227–238 | 1–121 | 26–35 | 50–66 | 99–110 | GYDSSAFRAFDI (SEQ ID NO: 2136) |
| I031G01 | 1273 | 137–248 | 160–172 | 188–194 | 227–237 | 1–121 | 26–35 | 50–66 | 99–110 | GYDSSAFRAFDI (SEQ ID NO: 2136) |
| I031G03 | 1274 | 147–258 | 170–182 | 198–204 | 237–247 | 1–131 | 26–35 | 50–66 | 99–120 | SSPPKWYDALTGHSSYHSAMDV (SEQ ID NO: 2159) |
| I031G05 | 1275 | 147–259 | 170–183 | 199–205 | 238–248 | 1–131 | 26–35 | 50–66 | 99–120 | GREDTDKVKPWDRYYHYYYMDV (SEQ ID NO: 2809) |
| I031G06 | 1276 | 147–258 | 170–182 | 198–204 | 237–247 | 1–131 | 26–35 | 50–66 | 99–120 | GREDTDKVKPWDRYYHYYYMDV (SEQ ID NO: 2809) |
| I031G07 | 1277 | 147–259 | 171–183 | 199–205 | 238–248 | 1–131 | 26–35 | 50–66 | 99–120 | SSPPKWYDALTGDSSYHSAMGV (SEQ ID NO: 2816) |
| I031G09 | 1278 | 147–263 | 170–183 | 199–209 | 244–252 | 1–131 | 26–35 | 50–66 | 99–120 | GREDTDKVKPWDRYYHYYYMDV (SEQ ID NO: 2809) |
| I031G12 | 1279 | 145–256 | 168–180 | 196–202 | 235–245 | 1–129 | 26–35 | 50–66 | 99–118 | AATTSQKHNKYAYYFYGMDV (SEQ ID NO: 2131) |
| I031H01 | 1280 | 137–250 | 160–173 | 189–195 | 228–239 | 1–121 | 26–35 | 50–66 | 99–110 | GYDSSAFRAFDI (SEQ ID NO: 2136) |
| I031H02 | 1281 | 142–255 | 165–178 | 194–200 | 233–244 | 1–126 | 26–35 | 50–66 | 99–115 | AKGYYYDSSGASDVFDV (SEQ ID NO: 2871) |
| I031H03 | 1282 | 147–260 | 170–183 | 199–205 | 238–249 | 1–131 | 26–35 | 50–66 | 99–120 | GREDTDKVKPWDRYYHYYYMDV (SEQ ID NO: 2809) |
| I031H06 | 1283 | 144–257 | 167–179 | 195–201 | 234–246 | 1–128 | 26–35 | 50–66 | 99–117 | DKAHGEYGRDYYYYYGMDV (SEQ ID NO: 2735) |
| I031H09 | 1284 | 144–255 | 167–179 | 195–201 | 234–244 | 1–128 | 26–35 | 50–66 | 99–117 | DKAHGEYGRDYYYYYGMDV (SEQ ID NO: 2735) |
| I031H10 | 1285 | 143–256 | 166–179 | 195–201 | 234–245 | 1–127 | 26–35 | 50–66 | 99–116 | DRGYTGYDRLVGGYYFDF (SEQ ID NO: 2931) |
| I031H11 | 1286 | 135–246 | 158–170 | 186–192 | 225–235 | 1–119 | 26–35 | 50–66 | 99–108 | DTVRSGGMDV (SEQ ID NO: 2804) |
| I033A08 | 1287 | 144–254 | 166–179 | 195–201 | 234–243 | 1–128 | 26–37 | 52–69 | 102–117 | DRYDILTGYYYYGMDV (SEQ ID NO: 2129) |
| I033B11 | 1288 | 144–254 | 166–179 | 195–201 | 234–243 | 1–128 | 26–37 | 52–69 | 102–117 | DRYDILTGYYYYGMDV (SEQ ID NO: 2129) |
| I033C01 | 1289 | 144–254 | 166–179 | 195–201 | 234–243 | 1–128 | 26–35 | 50–66 | 99–117 | EVRNYDLLTRSYLAGPLDN (SEQ ID NO: 2751) |
| I033C08 | 1290 | 142–249 | 163–173 | 189–195 | 228–238 | 1–126 | 26–35 | 50–66 | 99–115 | EMGYDILTGYYLNYMDV (SEQ ID NO: 2862) |
| I033D02 | 1291 | 138–245 | 161–171 | 187–193 | 226–234 | 1–122 | 26–35 | 50–66 | 99–111 | GDYDILTGYYMDV (SEQ ID NO: 2781) |
| I033D03 | 1292 | 141–251 | 163–176 | 192–198 | 231–240 | 1–125 | 26–35 | 50–66 | 99–114 | ATYDPLTGYSFDGFDI (SEQ ID NO: 2153) |
| I033D05 | 1293 | 141–248 | 162–172 | 188–194 | 227–237 | 1–125 | 26–35 | 50–66 | 99–114 | ATYDPLTGYSFDGFDI (SEQ ID NO: 2153) |
| I033D11 | 1294 | 140–247 | 161–171 | 187–193 | 226–236 | 1–124 | 26–35 | 50–66 | 99–113 | VKRDILTGYVEGMDV (SEQ ID NO: 2869) |
| I033D12 | 1295 | 144–254 | 166–179 | 195–201 | 234–243 | 1–128 | 26–35 | 50–66 | 99–117 | GGPHYDILTGYYMAVGFDI (SEQ ID NO: 2962) |
| I033E01 | 1296 | 139–249 | 161–173 | 189–195 | 228–238 | 1–123 | 26–35 | 50–66 | 99–112 | DIDARLAALDAFDI (SEQ ID NO: 2794) |
| I033E06 | 1297 | 141–251 | 163–176 | 192–198 | 231–240 | 1–125 | 26–35 | 50–66 | 99–114 | ATHDPLTGYSFDGFDI (SEQ ID NO: 2780) |
| I033E11 | 1298 | 143–253 | 165–177 | 193–199 | 232–242 | 1–127 | 26–35 | 50–66 | 99–116 | HRSRSCSSTSCRNDAFDI (SEQ ID NO: 2770) |
| I033E12 | 1299 | 142–249 | 163–173 | 189–195 | 228–238 | 1–126 | 26–35 | 50–66 | 99–115 | EMGYDILTGYYLNYMDV (SEQ ID NO: 2862) |
| I033F03 | 1300 | 139–246 | 160–170 | 186–192 | 225–235 | 1–123 | 26–35 | 50–66 | 99–112 | EGAADYLNGQYFQD (SEQ ID NO: 2768) |
| I033F08 | 1301 | 145–256 | 167–179 | 195–201 | 234–245 | 1–129 | 26–35 | 50–66 | 99–118 | QKVYYDILTGYNYYYYGMDV (SEQ ID NO: 2767) |
| I033F10 | 1302 | 144–254 | 166–179 | 195–201 | 234–243 | 1–128 | 26–35 | 50–66 | 99–117 | EVRNYDLLTRSYLAGPLDN (SEQ ID NO: 2751) |
| I033F12 | 1303 | 134–241 | 155–165 | 181–187 | 220–230 | 1–118 | 26–35 | 50–66 | 99–107 | DIDIGGDDS (SEQ ID NO: 2954) |
| I033G01 | 1304 | 143–253 | 165–178 | 194–200 | 233–242 | 1–127 | 24–33 | 48–64 | 97–116 | EGGNYDILTGYYIGNGAFDI (SEQ ID NO: 2158) |
| I033G03 | 1305 | 142–249 | 163–173 | 189–195 | 228–238 | 1–126 | 26–35 | 50–66 | 99–115 | PQGVTLVRGAETDAFAI (SEQ ID NO: 2925) |
| I033G08 | 1306 | 141–248 | 162–172 | 188–194 | 227–237 | 1–125 | 26–35 | 50–66 | 99–114 | ATYDPLTGYSFDGFDI (SEQ ID NO: 2153) |
| I033H04 | 1307 | 140–247 | 161–171 | 187–193 | 226–236 | 1–124 | 25–34 | 49–65 | 98–113 | ATYDPLTGYSFDGFDI (SEQ ID NO: 2153) |
| I037A05 | 1308 | 139–246 | 160–170 | 186–192 | 225–235 | 1–123 | 26–35 | 50–66 | 99–112 | SRDLLLFPHYGMDV (SEQ ID NO: 2133) |
| I037B03 | 1309 | 141–251 | 163–175 | 191–197 | 230–240 | 1–125 | 26–35 | 50–66 | 99–114 | SHYDILTRLNYWYFDL (SEQ ID NO: 2950) |
| I037B04 | 1310 | 144–251 | 167–177 | 193–199 | 232–240 | 1–128 | 26–35 | 50–66 | 99–117 | DPGYYDILTGYFHRYGMDV (SEQ ID NO: 2922) |
| I037C04 | 1311 | 142–252 | 164–177 | 193–199 | 232–241 | 1–126 | 26–35 | 50–65 | 98–115 | ENGDYDILTGQTFYGMDV (SEQ ID NO: 2752) |
| I037C06 | 1312 | 141–249 | 163–173 | 189–195 | 228–238 | 1–125 | 26–35 | 50–66 | 99–114 | LYYDILTGYHWDAFDI (SEQ ID NO: 2882) |
| I037C08 | 1313 | 140–250 | 162–175 | 191–197 | 230–239 | 1–124 | 26–35 | 50–66 | 99–113 | DGIDILLVPAALMDV (SEQ ID NO: 2160) |
| I037D11 | 1314 | 136–246 | 158–171 | 187–193 | 226–235 | 1–120 | 26–35 | 50–66 | 99–109 | SQWLEHDVFDI (SEQ ID NO: 2864) |
| I037E06 | 1315 | 144–251 | 165–175 | 191–197 | 230–240 | 1–128 | 26–35 | 50–66 | 99–117 | DRRDYDLLTRYYYYYGMDV (SEQ ID NO: 2928) |

TABLE 1-continued scFvs that Immunospecifically Bind to BLyS

| Clone ID | scFv SEQ ID NO | AAs of VL | AAs of VL CDR1 | AAs of VL CDR2 | AAs of VL CDR3 | AAs of VH | AAs of VH CDR1 | AAs of VH CDR2 | AAs of VH CDR3 | VH CDR3 Sequence (SEQ ID NO) |
|---|---|---|---|---|---|---|---|---|---|---|
| I037F04 | 1316 | 144–251 | 165–175 | 191–197 | 230–240 | 1–128 | 26–35 | 50–65 | 98–117 | KQRGDYDILTGYQLGYAFDI (SEQ ID NO: 2808) |
| I037G01 | 1317 | 141–251 | 163–176 | 192–198 | 231–240 | 1–125 | 26–35 | 50–66 | 99–114 | SHYDILTRLNYWYFDL (SEQ ID NO: 2950) |
| I037G03 | 1318 | 146–256 | 168–181 | 197–203 | 236–245 | 1–130 | 26–35 | 50–66 | 99–119 | DLGSFYDILTALRLENYGMDV (SEQ ID NO: 2963) |
| I037G10 | 1319 | 140–250 | 162–175 | 191–197 | 230–239 | 1–124 | 26–35 | 50–66 | 99–113 | DYYDILTKLPYGMDV (SEQ ID NO: 2975) |
| I042A07 | 1320 | 144–251 | 167–177 | 193–199 | 232–240 | 1–128 | 26–35 | 50–66 | 99–117 | VSPSYDILTGYYLPHAFDV (SEQ ID NO: 2849) |
| I042A10 | 1321 | 142–249 | 165–175 | 191–197 | 230–238 | 1–126 | 26–35 | 50–65 | 98–115 | GPRYYDILTGYRYNWFDP (SEQ ID NO: 2801) |
| I042B03 | 1322 | 140–247 | 161–171 | 187–193 | 226–236 | 1–124 | 26–35 | 50–66 | 99–113 | DIDDILTGYVLGMDV (SEQ ID NO: 2924) |
| I042B12 | 1323 | 141–248 | 162–172 | 188–194 | 227–237 | 1–125 | 26–35 | 50–66 | 99–114 | SHYDILTGLNYWYFDL (SEQ ID NO: 2166) |
| I042D01 | 1324 | 136–246 | 158–171 | 187–193 | 226–235 | 1–120 | 26–35 | 50–66 | 99–109 | QQWLPYDAFDI (SEQ ID NO: 2839) |
| I042D03 | 1325 | 140–250 | 162–175 | 191–197 | 230–239 | 1–124 | 26–35 | 50–68 | 101–113 | AYYDILTGYFFDI (SEQ ID NO: 2873) |
| I042D10 | 1326 | 142–252 | 164–177 | 193–199 | 232–241 | 1–126 | 26–35 | 50–65 | 98–115 | ERADYDILTGYYFYGMDV (SEQ ID NO: 2802) |
| I042E10 | 1327 | 147–257 | 169–182 | 198–204 | 237–246 | 1–131 | 26–37 | 52–69 | 102–120 | ERPYYDILTGYTVTYGMDV (SEQ ID NO: 2798) |
| I042E11 | 1328 | 140–247 | 161–171 | 187–193 | 226–236 | 1–124 | 26–35 | 50–66 | 99–113 | DEYDILTGLLQGMDV (SEQ ID NO: 2883) |
| I042F08 | 1329 | 142–252 | 164–177 | 193–199 | 232–241 | 1–126 | 26–37 | 52–67 | 100–115 | GDYDILTGYPLHAFDI (SEQ ID NO: 2738) |
| I042F12 | 1330 | 140–247 | 161–171 | 187–193 | 226–236 | 1–124 | 26–35 | 50–66 | 99–113 | DGYDILTGYYFGMDV (SEQ ID NO: 2976) |
| I042G08 | 1331 | 141–248 | 162–172 | 188–194 | 227–237 | 1–125 | 26–35 | 50–66 | 99–114 | EHYDILTGYSLLGMDV (SEQ ID NO: 2907) |
| I042G10 | 1332 | 141–251 | 163–176 | 192–198 | 231–240 | 1–125 | 26–35 | 50–66 | 99–114 | SHYDILTGLNYWYFDL (SEQ ID NO: 2166) |
| I042H03 | 1333 | 143–253 | 165–178 | 194–200 | 233–242 | 1–127 | 26–35 | 50–65 | 98–116 | GSLYYDILTGYYIGNAFDI (SEQ ID NO: 2759) |
| I043A03 | 1334 | 144–254 | 166–179 | 195–201 | 234–243 | 1–128 | 26–35 | 50–66 | 99–117 | DGYYDILTGGFYYYYGMDV (SEQ ID NO: 2899) |
| I043B02 | 1335 | 142–249 | 163–173 | 189–195 | 228–238 | 1–126 | 26–35 | 50–65 | 98–115 | GGYYDILTGYLVYYGMDV (SEQ ID NO: 2744) |
| I043B03 | 1336 | 141–251 | 163–176 | 192–198 | 231–240 | 1–125 | 26–35 | 50–66 | 99–114 | ATYDPLTGYSFDGFDI (SEQ ID NO: 2153) |
| I043B06 | 1337 | 143–253 | 165–178 | 194–200 | 233–242 | 1–127 | 26–35 | 50–66 | 99–116 | DQQYDILTGYHIDYYMDV (SEQ ID NO: 2828) |
| I043B07 | 1338 | 141–251 | 163–176 | 192–198 | 231–240 | 1–125 | 26–35 | 50–66 | 99–114 | ATYDPLTGYSFDGFDI (SEQ ID NO: 2153) |
| I043B09 | 1339 | 143–253 | 165–178 | 194–200 | 233–242 | 1–127 | 26–35 | 50–65 | 98–116 | HVRDYDILTGYYRGHHFDY (SEQ ID NO: 2727) |
| I043D11 | 1340 | 144–254 | 166–179 | 195–201 | 234–243 | 1–128 | 26–35 | 50–66 | 99–117 | EVRNYDLLTRSYLAGPLDN (SEQ ID NO: 2751) |
| I043E05 | 1341 | 143–250 | 164–174 | 190–196 | 229–239 | 1–127 | 26–35 | 50–66 | 99–116 | TESNYDILTGYYWPSMDV (SEQ ID NO: 2940) |
| I043F01 | 1342 | 141–251 | 163–176 | 192–198 | 231–240 | 1–125 | 26–35 | 50–66 | 99–114 | ATYDPLTGYSFDGFDI (SEQ ID NO: 2153) |
| I043F04 | 1343 | 141–251 | 163–176 | 192–198 | 231–240 | 1–125 | 26–35 | 50–66 | 99–114 | ATYDPLTGYSFDGFDI (SEQ ID NO: 2153) |
| I043F12 | 1344 | 143–250 | 164–174 | 190–196 | 229–239 | 1–127 | 26–35 | 50–66 | 99–116 | TESNYDILTGYYWPSMDV (SEQ ID NO: 2940) |
| I043H07 | 1345 | 141–251 | 163–176 | 192–198 | 231–240 | 1–125 | 26–35 | 50–66 | 99–114 | ATYDPLTGYSFDGFDI (SEQ ID NO: 2153) |
| I044A11 | 1346 | 144–251 | 165–175 | 191–197 | 230–240 | 1–128 | 26–35 | 50–68 | 101–117 | APYDILTGYSDYYGMDV (SEQ ID NO: 2968) |
| I044B11 | 1347 | 139–249 | 161–173 | 189–195 | 228–238 | 1–123 | 26–35 | 50–66 | 99–112 | DSDARLAALDAFDI (SEQ ID NO: 2978) |
| I044C09 | 1348 | 140–250 | 162–174 | 190–196 | 229–239 | 1–124 | 26–35 | 50–66 | 99–113 | GQFGVLPNYYYHMDV (SEQ ID NO: 2943) |
| I044C10 | 1349 | 143–253 | 165–177 | 193–199 | 232–242 | 1–127 | 26–35 | 50–66 | 99–116 | DIKRYNSNWPYYDYYMDV (SEQ ID NO: 2726) |
| I044D03 | 1350 | 144–254 | 166–179 | 195–201 | 234–243 | 1–128 | 26–35 | 50–66 | 99–117 | DKQYYDILTGDPVEGGMDV (SEQ ID NO: 2889) |
| I044D09 | 1351 | 141–251 | 163–176 | 192–198 | 231–240 | 1–125 | 26–35 | 50–66 | 99–114 | ATYDPLTGYSFDGFDI (SEQ ID NO: 2153) |
| I044E07 | 1352 | 137–247 | 159–172 | 188–194 | 227–236 | 1–121 | 26–35 | 50–66 | 99–110 | AGSSLVTYGTDV (SEQ ID NO: 2825) |
| I044E11 | 1353 | 143–253 | 165–178 | 194–200 | 233–242 | 1–127 | 26–35 | 50–66 | 99–116 | SDDYDILTGNYVGSLLDY (SEQ ID NO: 2758) |
| I044F07 | 1354 | 147–257 | 169–182 | 198–204 | 237–246 | 1–131 | 26–35 | 50–66 | 99–120 | DGRLSYDILTGYYARDYYGMDV (SEQ ID NO: 2912) |
| I044G02 | 1355 | 141–251 | 163–176 | 192–198 | 231–240 | 1–125 | 26–35 | 50–66 | 99–114 | ATYDPLTGYSFDGFDI (SEQ ID NO: 2153) |
| I044G07 | 1356 | 149–259 | 171–184 | 200–206 | 239–248 | 1–133 | 26–35 | 50–66 | 99–122 | DQNHPIYDILTGYYVPTGPLELKN (SEQ ID NO: 2845) |
| I044H01 | 1357 | 144–251 | 165–175 | 191–197 | 230–240 | 1–128 | 26–35 | 50–66 | 99–117 | EVRNYDLLTRSYLAGPLDN (SEQ ID NO: 2751) |
| I050A01 | 1358 | 141–253 | 164–177 | 193–199 | 232–242 | 1–125 | 26–35 | 50–66 | 99–114 | DMGYDILTGYYGAFDI (SEQ ID NO: 2946) |
| I050B12 | 1359 | 141–253 | 164–177 | 193–199 | 232–242 | 1–125 | 26–35 | 50–66 | 99–114 | DYYDVLTGFSLDGMDV (SEQ ID NO: 2829) |
| I050C06 | 1360 | 140–248 | 165–175 | 191–197 | 230–237 | 1–124 | 26–35 | 50–65 | 98–113 | DHYDVLTGSYLQAFDV (SEQ ID NO: 2728) |
| I050C08 | 1361 | 141–253 | 164–177 | 193–199 | 232–242 | 1–125 | 26–37 | 52–67 | 100–114 | GRYDFLTGYLRNFDY (SEQ ID NO: 2731) |
| I050E01 | 1362 | 140–252 | 163–176 | 192–198 | 231–241 | 1–124 | 26–35 | 50–66 | 99–113 | GHYDILTGYYFGFDY (SEQ ID NO: 2886) |

TABLE 1-continued scFvs that Immunospecifically Bind to BLyS

| Clone ID | scFv SEQ ID NO | AAs of VL | AAs of VL CDR1 | AAs of VL CDR2 | AAs of VL CDR3 | AAs of VH | AAs of VH CDR1 | AAs of VH CDR2 | AAs of VH CDR3 | VH CDR3 Sequence (SEQ ID NO) |
|---|---|---|---|---|---|---|---|---|---|---|
| I050E10 | 1363 | 137–248 | 160–172 | 188–194 | 227–237 | 1–121 | 26–35 | 50–66 | 99–110 | DMKVYYKYALDV (SEQ ID NO: 2823) |
| I050H08 | 1364 | 141–253 | 164–177 | 193–199 | 232–242 | 1–125 | 26–35 | 50–66 | 99–114 | DLRYDILTGYHDAFDI (SEQ ID NO: 2890) |
| I051A04 | 1365 | 147–258 | 170–183 | 199–205 | 238–247 | 1–131 | 26–35 | 50–66 | 99–120 | SSPPKWYDALTGHSSYHSAMDV (SEQ ID NO: 2159) |
| I051A08 | 1366 | 141–252 | 164–176 | 192–198 | 231–241 | 1–125 | 26–35 | 50–66 | 99–114 | HRRARVVVPVPGAMDV (SEQ ID NO: 2930) |
| I051A12 | 1367 | 143–250 | 164–174 | 190–196 | 229–239 | 1–127 | 26–35 | 50–66 | 99–116 | DGSYDILTGYYIDNYMDV (SEQ ID NO: 2154) |
| I051B08 | 1368 | 142–253 | 165–177 | 193–199 | 232–242 | 1–126 | 26–36 | 51–67 | 100–115 | RSMIVVTTAPYDAFDL (SEQ ID NO: 2785) |
| I051C06 | 1369 | 135–246 | 158–170 | 186–192 | 225–235 | 1–119 | 26–35 | 50–66 | 99–108 | DTVRSGGMDV (SEQ ID NO: 2804) |
| I051G12 | 1370 | 143–250 | 164–174 | 190–196 | 229–239 | 1–127 | 26–35 | 50–66 | 99–116 | DGSYDILTGYYIDNYMDV (SEQ ID NO: 2154) |
| I055A05 | 1371 | 133–244 | 156–169 | 185–191 | 224–233 | 1–117 | 26–35 | 50–66 | 99–106 | SGPGWFDP (SEQ ID NO: 2870) |
| I055A11 | 1372 | 133–244 | 156–169 | 185–191 | 224–233 | 1–117 | 26–35 | 50–66 | 99–106 | SGPGWFDP (SEQ ID NO: 2870) |
| I061A03 | 1373 | 140–251 | 163–176 | 192–198 | 231–240 | 1–124 | 26–34 | 49–65 | 98–113 | ELGSSIVGATTGALDM (SEQ ID NO: 2852) |
| I061A04 | 1374 | 141–251 | 165–175 | 191–197 | 230–240 | 1–125 | 26–35 | 50–66 | 99–114 | GDYDILTGYPAECFQI (SEQ ID NO: 2854) |
| I061A08 | 1375 | 140–253 | 164–176 | 192–198 | 233–242 | 1–124 | 26–35 | 50–66 | 99–113 | DNYDILTGYSRRFDP (SEQ ID NO: 2942) |
| I061A09 | 1376 | 140–252 | 164–176 | 192–198 | 231–241 | 1–124 | 26–34 | 49–65 | 98–113 | ELGLSIVGATTGALDM (SEQ ID NO: 2174) |
| I061A10 | 1377 | 140–249 | 163–173 | 189–195 | 228–238 | 1–124 | 26–34 | 49–65 | 98–113 | ELGLSIVGATTGALDM (SEQ ID NO: 2174) |
| I061B07 | 1378 | 140–252 | 163–176 | 192–198 | 231–241 | 1–124 | 26–34 | 49–65 | 98–113 | ELGLSIVGATTGALDM (SEQ ID NO: 2174) |
| I061B09 | 1379 | 143–253 | 165–178 | 194–200 | 233–242 | 1–127 | 24–33 | 48–64 | 97–116 | EGGNYDILTGYYIGNGAFDI (SEQ ID NO: 2158) |
| I061B12 | 1380 | 141–251 | 163–176 | 192–198 | 231–240 | 1–125 | 26–35 | 50–66 | 99–114 | ATYDPLTGYSFDGFDI (SEQ ID NO: 2153) |
| I061C12 | 1381 | 138–248 | 160–173 | 189–195 | 228–237 | 1–122 | 26–35 | 50–66 | 99–111 | TYYDILTGYHFDY (SEQ ID NO: 2788) |
| I061D01 | 1382 | 137–247 | 159–172 | 188–194 | 227–236 | 1–121 | 26–35 | 50–68 | 101–110 | GPGVIGNYDY (SEQ ID NO: 2749) |
| I061D03 | 1383 | 141–251 | 163–176 | 192–198 | 231–240 | 1–125 | 26–35 | 50–66 | 99–114 | ATYDPLTGYSFDGFDI (SEQ ID NO: 2153) |
| I061D04 | 1384 | 140–247 | 161–171 | 187–193 | 226–236 | 1–124 | 26–35 | 50–66 | 99–113 | AVLRYSAGLQGAFDI (SEQ ID NO: 2970) |
| I061D07 | 1385 | 141–248 | 164–174 | 190–196 | 229–237 | 1–125 | 26–35 | 50–66 | 99–114 | VSGYNSGYFESYDMDV (SEQ ID NO: 2732) |
| I061D09 | 1386 | 141–248 | 162–172 | 188–194 | 227–237 | 1–125 | 26–35 | 50–66 | 99–114 | LNLEKTVVRGFGYFDL (SEQ ID NO: 2952) |
| I061D10 | 1387 | 141–248 | 162–172 | 188–194 | 227–237 | 1–125 | 26–35 | 50–66 | 99–114 | DHYDILTGLYYYGMDV (SEQ ID NO: 2760) |
| I061E01 | 1388 | 141–248 | 162–172 | 188–194 | 227–237 | 1–125 | 26–35 | 50–66 | 99–114 | LNLEKTVVRGFGYFDL (SEQ ID NO: 2952) |
| I061E05 | 1389 | 142–251 | 163–175 | 191–197 | 230–240 | 1–126 | 26–35 | 50–66 | 99–115 | GGELVWFGESDYYGMDV (SEQ ID NO: 2787) |
| I061E09 | 1390 | 141–251 | 163–176 | 192–198 | 231–240 | 1–125 | 26–35 | 50–66 | 99–114 | ATYDPLTGYSFDGFDI (SEQ ID NO: 2153) |
| I061E12 | 1391 | 133–240 | 154–164 | 180–186 | 219–229 | 1–117 | 26–35 | 50–66 | 99–106 | SQRLFIDS (SEQ ID NO: 2842) |
| I061F01 | 1392 | 146–256 | 168–181 | 197–203 | 236–245 | 1–130 | 26–35 | 50–66 | 99–119 | DRYYDILTGYYIPGLDDAFDI (SEQ ID NO: 2887) |
| I061F09 | 1393 | 139–246 | 160–170 | 186–192 | 225–235 | 1–123 | 26–35 | 50–66 | 99–112 | DSDARLAALDAFDI (SEQ ID NO: 2978) |
| I061F10 | 1394 | 145–252 | 166–176 | 192–198 | 231–241 | 1–129 | 26–35 | 50–66 | 99–118 | EESYYDILTGYYVHYYGMDV (SEQ ID NO: 2743) |
| I061F11 | 1395 | 141–251 | 163–176 | 192–198 | 231–240 | 1–125 | 26–35 | 50–66 | 99–114 | ATYDPLTGYYFDGFDI (SEQ ID NO: 2949) |
| I061G01 | 1396 | 141–251 | 163–176 | 192–198 | 231–240 | 1–125 | 26–35 | 50–66 | 99–114 | ATYDPLTGYSFDGFDI (SEQ ID NO: 2153) |
| I061G03 | 1397 | 141–251 | 163–176 | 192–198 | 231–240 | 1–125 | 26–35 | 50–66 | 99–114 | AYYDILTGFLPYDMDL (SEQ ID NO: 2771) |
| I061G09 | 1398 | 144–254 | 166–179 | 195–201 | 234–243 | 1–128 | 26–35 | 50–66 | 99–117 | EVRNYDLLTRSYLAGPLDN (SEQ ID NO: 2751) |
| I061G10 | 1399 | 143–253 | 165–178 | 194–200 | 233–242 | 1–127 | 26–35 | 50–65 | 98–116 | EGSYDILTGYYVGVGRMDV (SEQ ID NO: 2171) |
| I061G11 | 1400 | 137–247 | 159–171 | 187–193 | 226–236 | 1–121 | 26–35 | 50–68 | 101–110 | RDILTGFYDS (SEQ ID NO: 2933) |
| I061H05 | 1401 | 142–252 | 164–177 | 193–199 | 232–241 | 1–126 | 26–37 | 52–67 | 100–115 | ATYDPLTGYSFDGFDI (SEQ ID NO: 2153) |
| I064A05 | 1402 | 142–249 | 163–173 | 189–195 | 228–238 | 1–126 | 26–35 | 50–68 | 101–115 | DFYDILTGYQHGMDV (SEQ ID NO: 2919) |
| I064A11 | 1403 | 138–248 | 160–173 | 189–195 | 228–237 | 1–122 | 26–35 | 50–66 | 99–111 | HSKEYNWNYALDY (SEQ ID NO: 2754) |
| I064B01 | 1404 | 138–248 | 160–173 | 189–195 | 228–237 | 1–122 | 26–35 | 50–66 | 99–111 | TRMDVLTRYYSDF (SEQ ID NO: 2750) |
| I064B02 | 1405 | 144–254 | 166–179 | 195–201 | 234–243 | 1–128 | 26–35 | 50–66 | 99–117 | AFEDYDILTGYYHHDAFDI (SEQ ID NO: 2911) |
| I064B12 | 1406 | 133–243 | 155–168 | 184–190 | 223–232 | 1–117 | 26–35 | 50–66 | 99–106 | PSYHYMDV (SEQ ID NO: 2740) |
| I064C06 | 1407 | 145–255 | 167–180 | 196–202 | 235–244 | 1–129 | 26–35 | 50–66 | 99–118 | VNADYDILTGYPRDYYGMDV (SEQ ID NO: 2819) |
| I064D01 | 1408 | 141–251 | 163–176 | 192–198 | 231–240 | 1–125 | 26–35 | 50–66 | 99–114 | ATYDPLTGYSFDGFDI (SEQ ID NO: 2153) |
| I064D02 | 1409 | 146–256 | 168–181 | 197–203 | 236–245 | 1–130 | 26–35 | 50–66 | 99–119 | EDATYYDILTGYYMGSYGMDV (SEQ ID NO: 2763) |

TABLE 1-continued scFvs that Immunospecifically Bind to BLyS

| Clone ID | scFv SEQ ID NO | AAs of VL | AAs of VL CDR1 | AAs of VL CDR2 | AAs of VL CDR3 | AAs of VH | AAs of VH CDR1 | AAs of VH CDR2 | AAs of VH CDR3 | VH CDR3 Sequence (SEQ ID NO) |
|---|---|---|---|---|---|---|---|---|---|---|
| I064E01 | 1410 | 143–250 | 166–176 | 192–198 | 231–239 | 1–127 | 26–35 | 50–66 | 99–116 | ETRKYTSSPPYNYYYMDV (SEQ ID NO: 2736) |
| I064E02 | 1411 | 140–251 | 162–174 | 190–196 | 229–240 | 1–124 | 26–35 | 50–66 | 99–113 | RDYDILTGYSRGFDP (SEQ ID NO: 2725) |
| I064E03 | 1412 | 144–254 | 166–179 | 195–201 | 234–243 | 1–128 | 26–35 | 50–66 | 99–117 | DGIYDILTTLVSYYNGMDV (SEQ ID NO: 2775) |
| I064E07 | 1413 | 140–250 | 162–175 | 191–197 | 230–239 | 1–124 | 26–35 | 50–65 | 98–113 | GERDILTGYYLDGMDV (SEQ ID NO: 2948) |
| I064E08 | 1414 | 140–250 | 162–174 | 190–196 | 229–239 | 1–124 | 26–35 | 50–66 | 99–113 | ERGSYSSGYSGAFDV (SEQ ID NO: 2898) |
| I064F05 | 1415 | 142–252 | 164–177 | 193–199 | 232–241 | 1–126 | 26–35 | 50–66 | 99–115 | ESGGYSYGSRDYYGMDV (SEQ ID NO: 2836) |
| I064F08 | 1416 | 145–252 | 166–176 | 192–198 | 231–241 | 1–129 | 26–35 | 50–66 | 99–118 | DRGVGYDILTGRTYYYGMDV (SEQ ID NO: 2900) |
| I064G06 | 1417 | 141–248 | 162–172 | 188–194 | 227–237 | 1–125 | 26–35 | 50–66 | 99–114 | ATYDPLTGYSFDGFDI (SEQ ID NO: 2153) |
| I065A12 | 1418 | 143–253 | 165–178 | 194–200 | 233–242 | 1–127 | 26–35 | 50–66 | 99–116 | DVSGHDILTGYSYRYFDV (SEQ ID NO: 2795) |
| I065C04 | 1419 | 139–249 | 161–173 | 189–195 | 228–238 | 1–123 | 26–35 | 50–66 | 99–112 | GQKNYYESSGYLEH (SEQ ID NO: 2916) |
| I065C09 | 1420 | 140–250 | 162–174 | 190–196 | 229–239 | 1–124 | 26–35 | 50–66 | 99–113 | GDYDILTGYYSHFDY (SEQ ID NO: 2908) |
| I065E02 | 1421 | 141–248 | 164–174 | 190–196 | 229–237 | 1–125 | 26–35 | 50–66 | 99–114 | AYDYDILTGYSYYFDY (SEQ ID NO: 2895) |
| I065E04 | 1422 | 135–245 | 157–169 | 185–191 | 224–234 | 1–119 | 26–35 | 50–66 | 99–108 | GMGDHYGMDV (SEQ ID NO: 2161) |
| I065F03 | 1423 | 137–247 | 159–172 | 188–194 | 227–236 | 1–121 | 26–35 | 50–66 | 99–110 | AGSSLMTYGTDV (SEQ ID NO: 2773) |
| I065G06 | 1424 | 135–242 | 156–166 | 182–188 | 221–231 | 1–119 | 26–35 | 50–66 | 99–108 | GMGDHYGMDV (SEQ ID NO: 2161) |
| I065G07 | 1425 | 142–249 | 163–173 | 189–195 | 228–238 | 1–126 | 26–35 | 50–66 | 99–115 | GGNYDILTGYYIGAFDI (SEQ ID NO: 2824) |
| I065G08 | 1426 | 139–246 | 160–170 | 186–192 | 225–235 | 1–123 | 26–35 | 50–66 | 99–112 | SRDLLLFPHYGMDV (SEQ ID NO: 2133) |
| I065H06 | 1427 | 144–254 | 166–179 | 195–201 | 234–243 | 1–128 | 26–35 | 50–66 | 99–117 | GYEYYDILTGYNELGAFDI (SEQ ID NO: 2851) |
| I066A03 | 1428 | 144–254 | 166–179 | 195–201 | 234–243 | 1–128 | 26–35 | 50–66 | 99–117 | DGTYYDILTGYYNQYGMDV (SEQ ID NO: 2915) |
| I066A08 | 1429 | 137–247 | 159–171 | 187–193 | 226–236 | 1–121 | 26–35 | 50–66 | 99–110 | AGSSLMTYGTDV (SEQ ID NO: 2773) |
| I066A09 | 1430 | 135–245 | 157–169 | 185–191 | 224–234 | 1–119 | 26–35 | 50–66 | 99–108 | GMGDHYGMDV (SEQ ID NO: 2161) |
| I066A10 | 1431 | 142–252 | 164–177 | 193–199 | 232–241 | 1–126 | 26–35 | 50–66 | 99–115 | DRGYDILTGYYYYGMDV (SEQ ID NO: 2876) |
| I066A11 | 1432 | 143–253 | 165–178 | 194–200 | 233–242 | 1–127 | 26–35 | 50–66 | 99–116 | EVRDYDILTGYYISYMDV (SEQ ID NO: 2778) |
| I066B02 | 1433 | 135–242 | 156–166 | 182–188 | 221–231 | 1–119 | 26–35 | 50–66 | 99–108 | GMGDHYGMDV (SEQ ID NO: 2161) |
| I066B08 | 1434 | 137–247 | 159–172 | 188–194 | 227–236 | 1–121 | 26–35 | 50–66 | 99–110 | AGSSLMTYGTDV (SEQ ID NO: 2773) |
| I066B10 | 1435 | 142–252 | 164–177 | 193–199 | 232–241 | 1–126 | 26–35 | 50–66 | 99–115 | GLYFEDTNYRHGDAFDI (SEQ ID NO: 2790) |
| I066C02 | 1436 | 135–245 | 157–169 | 185–191 | 224–234 | 1–119 | 26–35 | 50–66 | 99–108 | GMGDHYGMDV (SEQ ID NO: 2161) |
| I066C11 | 1437 | 141–251 | 163–176 | 192–198 | 231–240 | 1–125 | 26–35 | 50–66 | 99–114 | ATYDPLTGYSFDGFDI (SEQ ID NO: 2153) |
| I066C12 | 1438 | 135–242 | 156–166 | 182–188 | 221–231 | 1–119 | 26–35 | 50–66 | 99–108 | GMGDHYGMDV (SEQ ID NO: 2161) |
| I066D06 | 1439 | 140–250 | 162–175 | 191–197 | 230–239 | 1–124 | 26–35 | 50–66 | 99–113 | ENYDFLTGYYGAFDI (SEQ ID NO: 2772) |
| I066D08 | 1440 | 138–248 | 160–173 | 189–195 | 228–237 | 1–122 | 26–35 | 50–66 | 99–111 | HSKEYNWNYALDY (SEQ ID NO: 2754) |
| I066D11 | 1441 | 144–254 | 166–179 | 195–201 | 234–243 | 1–128 | 26–35 | 50–66 | 99–117 | ERSQFDFLTGVDRYHPMDV (SEQ ID NO: 2956) |
| I066D12 | 1442 | 139–249 | 161–174 | 190–196 | 229–238 | 1–123 | 26–35 | 50–66 | 99–112 | EGAADYLNGQYFQH (SEQ ID NO: 2815) |
| I066E06 | 1443 | 137–247 | 159–171 | 187–193 | 226–236 | 1–121 | 26–35 | 50–66 | 99–110 | AGSSLMTYGTDV (SEQ ID NO: 2773) |
| I066E12 | 1444 | 135–242 | 156–166 | 182–188 | 221–231 | 1–119 | 26–35 | 50–66 | 99–108 | GMGDHYGMDV (SEQ ID NO: 2161) |
| I066G05 | 1445 | 142–249 | 163–173 | 189–195 | 228–238 | 1–126 | 26–35 | 50–66 | 99–115 | GLYFEDTNYRHGDAFDI (SEQ ID NO: 2790) |
| I066G08 | 1446 | 141–248 | 164–174 | 190–196 | 229–237 | 1–125 | 26–35 | 50–66 | 99–114 | VYYDILTGHPTYGMDV (SEQ ID NO: 2791) |
| I066G10 | 1447 | 144–254 | 166–178 | 194–200 | 233–243 | 1–128 | 26–35 | 50–68 | 101–117 | GIYDILTGYHWDDAFDI (SEQ ID NO: 2872) |
| I066G12 | 1448 | 143–254 | 165–177 | 193–199 | 232–243 | 1–127 | 26–35 | 50–66 | 99–116 | ESTYDILTGSYHDYGLDV (SEQ ID NO: 2822) |
| I066H04 | 1449 | 143–253 | 165–178 | 194–200 | 233–242 | 1–127 | 26–35 | 50–65 | 98–116 | DRLHYDILTGHQTDDAFDI (SEQ ID NO: 2885) |
| I067A07 | 1450 | 144–254 | 166–179 | 195–201 | 234–243 | 1–128 | 26–35 | 50–66 | 99–117 | VLTNYDILTGYYREDAFDM (SEQ ID NO: 2939) |
| I067A11 | 1451 | 135–245 | 157–170 | 186–192 | 225–234 | 1–119 | 26–35 | 50–66 | 99–108 | GMGDHYGMDV (SEQ ID NO: 2161) |
| I067B08 | 1452 | 149–259 | 171–184 | 200–206 | 239–248 | 1–133 | 26–35 | 50–66 | 99–122 | DRGASNYDILTGYYAPAQGVAFDI (SEQ ID NO: 2969) |
| I067C08 | 1453 | 148–258 | 170–183 | 199–205 | 238–247 | 1–132 | 26–37 | 52–69 | 102–121 | EGAHYDILTGHNYYHYGMDV (SEQ ID NO: 2747) |
| I067C09 | 1454 | 143–253 | 165–178 | 194–200 | 233–242 | 1–127 | 26–35 | 50–66 | 99–116 | ETRKYTSSPPYNYYYMDV (SEQ ID NO: 2736) |
| I067D07 | 1455 | 137–247 | 159–171 | 187–193 | 226–236 | 1–121 | 26–35 | 50–66 | 99–110 | AGSSLMTYGTDV (SEQ ID NO: 2773) |

TABLE 1-continued scFvs that Immunospecifically Bind to BLyS

| Clone ID | scFv SEQ ID NO | AAs of VL | AAs of VL CDR1 | AAs of VL CDR2 | AAs of VL CDR3 | AAs of VH | AAs of VH CDR1 | AAs of VH CDR2 | AAs of VH CDR3 | VH CDR3 Sequence (SEQ ID NO) |
|---|---|---|---|---|---|---|---|---|---|---|
| I067E01 | 1456 | 140–248 | 164–174 | 190–196 | 229–238 | 1–124 | 26–35 | 50–66 | 99–113 | DQHDILTGVYYGMDV (SEQ ID NO: 2921) |
| I067E06 | 1457 | 135–245 | 157–169 | 185–191 | 224–234 | 1–119 | 26–35 | 50–66 | 99–108 | GMGDHYGMDV (SEQ ID NO: 2161) |
| I067E07 | 1458 | 150–260 | 172–184 | 200–206 | 239–249 | 1–134 | 26–35 | 50–67 | 100–123 | DYPGSEYDILTGYLFGYYYYGMDV (SEQ ID NO: 2926) |
| I067E11 | 1459 | 141–251 | 163–176 | 192–198 | 231–240 | 1–125 | 26–35 | 50–66 | 99–114 | ATYDPLTGYSFDGFDI (SEQ ID NO: 2153) |
| I067G03 | 1460 | 140–250 | 162–175 | 191–197 | 230–239 | 1–124 | 26–35 | 50–66 | 99–113 | ARRVGVLGGKNAFEI (SEQ ID NO: 2765) |
| I067G05 | 1461 | 140–250 | 162–174 | 190–196 | 229–239 | 1–124 | 26–35 | 50–66 | 99–113 | DQHDILTGGYYGMDV (SEQ ID NO: 2894) |
| I067G12 | 1462 | 141–252 | 163–176 | 192–198 | 231–241 | 1–125 | 26–35 | 50–66 | 99–114 | ATYDPLTGYSFDGFDI (SEQ ID NO: 2153) |
| I067H05 | 1463 | 146–256 | 168–180 | 196–202 | 235–245 | 1–130 | 26–35 | 50–68 | 101–119 | EGTYYDILTGYYPLGYFDY (SEQ ID NO: 2936) |
| I067H06 | 1464 | 135–245 | 157–169 | 185–191 | 224–234 | 1–119 | 26–35 | 50–66 | 99–108 | GMGDHYGMDV (SEQ ID NO: 2161) |
| I068C09 | 1465 | 137–248 | 160–172 | 188–194 | 227–237 | 1–121 | 26–35 | 50–66 | 99–110 | GGSSQNFYGMDV (SEQ ID NO: 2884) |
| I068G03 | 1466 | 143–254 | 166–178 | 194–200 | 233–243 | 1–127 | 26–35 | 50–66 | 99–116 | GTGYDILTGYYMGSAFDQ (SEQ ID NO: 2800) |
| I068G04 | 1467 | 142–252 | 165–178 | 194–200 | 233–241 | 1–126 | 26–35 | 50–66 | 99–115 | GVVWVAYGDVGIYGFDV (SEQ ID NO: 2937) |
| I068G07 | 1468 | 140–251 | 164–174 | 190–196 | 229–240 | 1–124 | 26–35 | 50–66 | 99–113 | HDYYIMTAAHYYYDS (SEQ ID NO: 2909) |
| I068G08 | 1469 | 143–254 | 166–178 | 194–200 | 233–243 | 1–127 | 26–35 | 50–66 | 99–116 | GIGYDLLTGYFTGSPLDY (SEQ ID NO: 2846) |
| I070F07 | 1470 | 140–247 | 161–171 | 187–193 | 226–236 | 1–124 | 26–35 | 50–66 | 99–113 | DFYDILTGYHDAFDI (SEQ ID NO: 2910) |
| I070G05 | 1471 | 140–250 | 162–175 | 191–197 | 230–239 | 1–124 | 26–35 | 50–68 | 101–113 | DVDDILTGYSWDY (SEQ ID NO: 2867) |
| I070H02 | 1472 | 141–248 | 162–172 | 188–194 | 227–237 | 1–125 | 26–35 | 50–66 | 99–114 | MEYDILTGYYGGYFDY (SEQ ID NO: 2179) |
| I071A01 | 1473 | 141–251 | 163–176 | 192–198 | 231–240 | 1–125 | 26–35 | 50–66 | 99–114 | AAYDPLTGYSFDGFDI (SEQ ID NO: 2783) |
| I071A03 | 1474 | 143–250 | 164–174 | 190–196 | 229–239 | 1–127 | 26–35 | 50–66 | 99–116 | DMHYDILTGYYTGLAFDM (SEQ ID NO: 2917) |
| I071B08 | 1475 | 142–252 | 166–176 | 192–198 | 231–241 | 1–126 | 27–36 | 51–67 | 100–115 | GGYDILTQYPAEFFHP (SEQ ID NO: 2764) |
| I071E01 | 1476 | 138–248 | 160–173 | 189–195 | 228–237 | 1–122 | 26–35 | 50–66 | 99–111 | DFGVIGDYRPFDY (SEQ ID NO: 2777) |
| I071F11 | 1477 | 135–245 | 157–169 | 185–191 | 224–234 | 1–119 | 26–35 | 50–66 | 99–108 | SSNPVYGLDV (SEQ ID NO: 2957) |
| I071G11 | 1478 | 141–251 | 163–176 | 192–198 | 231–240 | 1–125 | 26–35 | 50–66 | 99–114 | ATYDPLTGYSFDGFDI (SEQ ID NO: 2153) |
| I071H08 | 1479 | 141–251 | 163–176 | 192–198 | 231–240 | 1–125 | 26–35 | 50–66 | 99–114 | ATYDPLTGYSFDGFDI (SEQ ID NO: 2153) |
| I074A02 | 1480 | 141–250 | 164–174 | 190–196 | 229–239 | 1–125 | 26–35 | 50–66 | 99–114 | DDRDILTNYYLEYFQH (SEQ ID NO: 2868) |
| I074A08 | 1481 | 147–259 | 170–182 | 198–204 | 237–248 | 1–131 | 26–35 | 50–66 | 99–120 | SSPPKWYDALTGDSSYHSAMDV (SEQ ID NO: 2165) |
| I074D10 | 1482 | 144–253 | 168–178 | 194–200 | 233–242 | 1–128 | 26–35 | 50–66 | 99–117 | DKTLGDQLVEAYYYDGMDV (SEQ ID NO: 2776) |
| I074E01 | 1483 | 144–255 | 168–178 | 194–200 | 233–244 | 1–128 | 26–35 | 50–66 | 99–117 | LGRTSRDLLTGYHFYNMDV (SEQ ID NO: 2944) |
| I074E02 | 1484 | 140–250 | 164–174 | 190–196 | 229–239 | 1–124 | 26–35 | 50–66 | 99–113 | DDYDILTGSLYYFDS (SEQ ID NO: 2803) |
| I074E08 | 1485 | 143–259 | 166–179 | 195–205 | 240–248 | 1–127 | 26–35 | 50–66 | 99–116 | GTGYDILTGYYMGSAFDQ (SEQ ID NO: 2800) |
| I074F12 | 1486 | 140–250 | 164–174 | 190–196 | 229–239 | 1–124 | 26–35 | 50–66 | 99–113 | DRADILTGYNDAFDI (SEQ ID NO: 2739) |
| I074H06 | 1487 | 139–251 | 162–175 | 191–197 | 230–240 | 1–123 | 26–35 | 50–66 | 99–112 | RYGDPFYYYYYMNV (SEQ ID NO: 2755) |
| I074H07 | 1488 | 143–253 | 167–177 | 193–199 | 232–242 | 1–127 | 26–35 | 50–66 | 99–116 | GTGYDILTGYYMGSAFDQ (SEQ ID NO: 2800) |
| I074H08 | 1489 | 142–254 | 165–178 | 194–200 | 233–243 | 1–126 | 26–35 | 50–66 | 99–115 | VSNDILTGWGGYNWFDP (SEQ ID NO: 2955) |
| I075A07 | 1490 | 143–253 | 167–177 | 193–199 | 232–242 | 1–127 | 26–35 | 50–66 | 99–116 | GTGYDILTGYYMGSAFDQ (SEQ ID NO: 2800) |
| I075B01 | 1491 | 133–244 | 156–168 | 184–190 | 223–233 | 1–117 | 26–35 | 50–66 | 99–106 | DQGRYLDL (SEQ ID NO: 2175) |
| I075B04 | 1492 | 133–247 | 156–169 | 185–191 | 224–236 | 1–117 | 26–35 | 50–66 | 99–106 | DQGRYLDL (SEQ ID NO: 2175) |
| I075B06 | 1493 | 140–252 | 163–175 | 191–197 | 230–241 | 1–124 | 26–34 | 49–65 | 98–113 | ELGLSIVGATTGALDM (SEQ ID NO: 2174) |
| I075B08 | 1494 | 143–257 | 166–179 | 195–201 | 234–246 | 1–127 | 26–35 | 50–66 | 99–116 | GTGYDILTGYYMGSAFDQ (SEQ ID NO: 2800) |
| I075B09 | 1495 | 141–252 | 164–176 | 192–198 | 231–241 | 1–125 | 26–35 | 50–66 | 99–114 | TYYDILTGYYAEYFQH (SEQ ID NO: 2932) |
| I075B12 | 1496 | 140–251 | 163–176 | 192–198 | 231–240 | 1–124 | 26–35 | 50–66 | 99–113 | SDYDILTGYYWVPAV (SEQ ID NO: 2812) |
| I075C01 | 1497 | 147–259 | 170–183 | 199–205 | 238–248 | 1–131 | 26–35 | 50–66 | 99–120 | GREDTDKVKPWDRYFHYYYMDV (SEQ ID NO: 2835) |
| I075C05 | 1498 | 133–244 | 156–168 | 184–190 | 223–233 | 1–117 | 26–35 | 50–66 | 99–106 | DQGRYLDL (SEQ ID NO: 2175) |
| I075D05 | 1499 | 143–253 | 168–179 | 195–201 | 234–242 | 1–127 | 26–35 | 50–66 | 99–116 | GTGYDILTGYYMGSVFDP (SEQ ID NO: 2897) |
| I075D07 | 1500 | 141–252 | 164–176 | 192–198 | 231–241 | 1–125 | 26–35 | 50–66 | 99–114 | SYYDILTGYYHTPLDY (SEQ ID NO: 2853) |
| I075D08 | 1501 | 140–251 | 163–175 | 191–197 | 230–240 | 1–124 | 26–34 | 49–65 | 98–113 | ELGLSIVGATTGALDM (SEQ ID NO: 2174) |

TABLE 1-continued scFvs that Immunospecifically Bind to BLyS

| Clone ID | scFv SEQ ID NO | AAs of VL | AAs of VL CDR1 | AAs of VL CDR2 | AAs of VL CDR3 | AAs of VH | AAs of VH CDR1 | AAs of VH CDR2 | AAs of VH CDR3 | VH CDR3 Sequence (SEQ ID NO) |
|---|---|---|---|---|---|---|---|---|---|---|
| I075E01 | 1502 | 143–253 | 167–177 | 193–199 | 232–242 | 1–127 | 26–35 | 50–66 | 99–116 | GTGYDILTGYYMGSAFDQ (SEQ ID NO: 2800) |
| I075E03 | 1503 | 148–261 | 172–184 | 200–206 | 239–250 | 1–132 | 28–37 | 52–68 | 101–121 | GGGYDILTGYSYPYLYYGLDV (SEQ ID NO: 2865) |
| I075E04 | 1504 | 143–255 | 166–179 | 195–201 | 234–244 | 1–127 | 26–35 | 50–66 | 99–116 | GRGYDVLTGYFTGSPLDY (SEQ ID NO: 2881) |
| I075E05 | 1505 | 140–252 | 163–176 | 192–198 | 231–241 | 1–124 | 26–34 | 49–65 | 98–113 | ELGLSIVGATTGALDM (SEQ ID NO: 2174) |
| I075E10 | 1506 | 140–252 | 163–176 | 192–198 | 231–241 | 1–124 | 26–34 | 49–65 | 98–113 | ELGLSIVGATTGALDM (SEQ ID NO: 2174) |
| I075E11 | 1507 | 133–244 | 156–168 | 184–190 | 223–233 | 1–117 | 26–35 | 50–66 | 99–106 | SGPGWFDP (SEQ ID NO: 2870) |
| I075E12 | 1508 | 142–254 | 165–178 | 194–200 | 233–243 | 1–126 | 26–35 | 50–66 | 99–115 | TDRFGAKDVTARWGMDV (SEQ ID NO: 2979) |
| I075F02 | 1509 | 144–253 | 168–178 | 194–200 | 233–242 | 1–128 | 26–35 | 50–66 | 99–117 | EQGYDILTGYYPEGGWFDP (SEQ ID NO: 2834) |
| I075F04 | 1510 | 141–251 | 164–176 | 192–198 | 231–240 | 1–125 | 26–37 | 52–67 | 100–114 | AGYDLLTGYPFYFDS (SEQ ID NO: 2757) |
| I075F06 | 1511 | 144–254 | 168–178 | 194–200 | 233–243 | 1–128 | 26–35 | 50–66 | 99–117 | GRNYYDFLTGYNFNLGLDY (SEQ ID NO: 2830) |
| I075F07 | 1512 | 140–251 | 163–175 | 191–197 | 230–240 | 1–124 | 26–35 | 50–66 | 99–113 | ENYDSLTGYYNYFDY (SEQ ID NO: 2971) |
| I075F08 | 1513 | 133–244 | 156–168 | 184–190 | 223–233 | 1–117 | 26–35 | 50–66 | 99–106 | DQRKAQDI (SEQ ID NO: 2779) |
| I075F09 | 1514 | 145–257 | 169–181 | 197–203 | 236–246 | 1–129 | 26–35 | 50–66 | 99–118 | LKAPYYDLLTGYHLPKWFDT (SEQ ID NO: 2953) |
| I075F10 | 1515 | 133–243 | 157–167 | 183–189 | 222–232 | 1–117 | 26–35 | 50–66 | 99–106 | DQGRYLDL (SEQ ID NO: 2175) |
| I075F11 | 1516 | 133–245 | 156–169 | 185–191 | 224–234 | 1–117 | 26–35 | 50–66 | 99–106 | DQGRYLDL (SEQ ID NO: 2175) |
| I075G05 | 1517 | 140–252 | 163–175 | 191–197 | 230–241 | 1–124 | 26–34 | 49–65 | 98–113 | ELGLSIVGATTGALDM (SEQ ID NO: 2174) |
| I075G07 | 1518 | 140–252 | 163–175 | 191–197 | 230–241 | 1–124 | 26–35 | 50–66 | 99–113 | GRYYDMLTRGGYFDY (SEQ ID NO: 2858) |
| I075G08 | 1519 | 140–252 | 163–176 | 192–198 | 231–241 | 1–124 | 26–35 | 50–66 | 99–113 | RQYDILTGYYGGFDY (SEQ ID NO: 2958) |
| I075G11 | 1520 | 141–253 | 164–177 | 193–199 | 232–242 | 1–125 | 26–35 | 50–66 | 99–114 | TDYDILTGYPMGYFDP (SEQ ID NO: 2173) |
| I075G12 | 1521 | 133–245 | 156–169 | 185–191 | 224–234 | 1–117 | 26–35 | 50–66 | 99–106 | DQGRYLDL (SEQ ID NO: 2175) |
| I075H02 | 1522 | 143–254 | 166–178 | 194–200 | 233–243 | 1–127 | 26–35 | 50–66 | 99–116 | GTGYDILTGYYMGSAFDQ (SEQ ID NO: 2800) |
| I075H03 | 1523 | 133–245 | 156–169 | 185–191 | 224–234 | 1–117 | 26–35 | 50–66 | 99–106 | DQGRYLDL (SEQ ID NO: 2175) |
| I075H06 | 1524 | 133–244 | 156–168 | 184–190 | 223–233 | 1–117 | 26–35 | 50–66 | 99–106 | DQGRYLDL (SEQ ID NO: 2175) |
| I075H08 | 1525 | 143–254 | 166–179 | 195–201 | 234–243 | 1–127 | 26–35 | 50–66 | 99–116 | GSGYDLLTGYFTGSPLDY (SEQ ID NO: 2766) |
| I076A01 | 1526 | 142–253 | 166–176 | 192–198 | 231–242 | 1–126 | 26–35 | 50–66 | 99–115 | DRRRDDLTGYLYDAFDS (SEQ ID NO: 2878) |
| I076A03 | 1527 | 135–247 | 159–171 | 187–193 | 226–236 | 1–119 | 26–35 | 50–68 | 101–108 | GYDTAMQY (SEQ ID NO: 2951) |
| I076A06 | 1528 | 133–245 | 156–168 | 184–190 | 223–234 | 1–117 | 26–35 | 50–66 | 99–106 | DQGRYLDL (SEQ ID NO: 2175) |
| I076A07 | 1529 | 139–250 | 162–174 | 190–196 | 229–239 | 1–123 | 26–35 | 50–66 | 99–112 | DRRDILTGSNFGQD (SEQ ID NO: 2913) |
| I076A08 | 1530 | 142–253 | 166–176 | 192–198 | 231–242 | 1–126 | 26–35 | 50–66 | 99–115 | MGHYDILTGYRHYGMDV (SEQ ID NO: 2831) |
| I076B01 | 1531 | 143–257 | 167–179 | 195–201 | 236–246 | 1–127 | 26–35 | 50–66 | 99–116 | GSGYDLLTGYFTGSPLDY (SEQ ID NO: 2766) |
| I076B03 | 1532 | 133–245 | 156–169 | 185–191 | 224–234 | 1–117 | 26–35 | 50–66 | 99–106 | DQGRYLDL (SEQ ID NO: 2175) |
| I076B07 | 1533 | 133–243 | 157–167 | 183–189 | 222–232 | 1–117 | 26–35 | 50–66 | 99–106 | DQGRYLDL (SEQ ID NO: 2175) |
| I076B08 | 1534 | 141–252 | 166–177 | 193–199 | 232–241 | 1–125 | 26–35 | 50–66 | 99–114 | PYYDPLTAYTFQYFGN (SEQ ID NO: 2806) |
| I076C04 | 1535 | 140–250 | 164–174 | 190–196 | 229–239 | 1–124 | 26–34 | 49–65 | 98–113 | ELGLSIVGATTGALDM (SEQ ID NO: 2174) |
| I076C10 | 1536 | 140–251 | 163–175 | 191–197 | 230–240 | 1–124 | 26–35 | 50–66 | 99–113 | GRYYDMLTRGGYFDY (SEQ ID NO: 2858) |
| I076D01 | 1537 | 141–252 | 164–176 | 192–198 | 231–241 | 1–125 | 26–35 | 50–66 | 99–114 | LDYDILTGYYPSGFDY (SEQ ID NO: 2799) |
| I076D08 | 1538 | 140–251 | 163–175 | 191–197 | 230–240 | 1–124 | 26–37 | 52–67 | 100–113 | RFYDLLTGYSAFDS (SEQ ID NO: 2756) |
| I076D11 | 1539 | 143–255 | 166–179 | 195–201 | 234–244 | 1–127 | 26–35 | 50–66 | 99–116 | GTGYDILTGYYMGSAFDQ (SEQ ID NO: 2800) |
| I076D12 | 1540 | 140–250 | 164–174 | 190–196 | 229–239 | 1–124 | 26–34 | 49–65 | 98–113 | ELGLSIVGATTGALDM (SEQ ID NO: 2174) |
| I076E04 | 1541 | 143–252 | 167–177 | 193–199 | 232–241 | 1–127 | 26–35 | 50–66 | 99–116 | GTGYDILTGYYMGSAFDQ (SEQ ID NO: 2800) |
| I076E07 | 1542 | 140–251 | 163–175 | 191–197 | 230–240 | 1–124 | 26–35 | 50–66 | 99–113 | EYYDVLTGLFYYMDV (SEQ ID NO: 2841) |
| I076E09 | 1543 | 141–253 | 164–177 | 193–199 | 232–242 | 1–125 | 26–35 | 50–66 | 99–114 | DDRDILTNYYLEYFQH (SEQ ID NO: 2868) |
| I076E11 | 1544 | 143–254 | 166–179 | 195–201 | 234–243 | 1–127 | 26–35 | 50–66 | 99–116 | GTGYDILTGYYMGSAFDQ (SEQ ID NO: 2800) |
| I076F01 | 1545 | 143–253 | 166–178 | 194–199 | 232–242 | 1–127 | 26–35 | 50–66 | 99–116 | GTGYDILTGYYMGSAFDQ (SEQ ID NO: 2800) |
| I076F03 | 1546 | 140–251 | 163–175 | 191–197 | 230–240 | 1–124 | 26–36 | 51–66 | 99–113 | GDYDVLTGYLRKLDY (SEQ ID NO: 2742) |
| I076F04 | 1547 | 133–245 | 157–169 | 185–191 | 224–234 | 1–117 | 26–35 | 50–66 | 99–106 | DQGRYLDL (SEQ ID NO: 2175) |

TABLE 1-continued scFvs that Immunospecifically Bind to BLyS

| Clone ID | scFv SEQ ID NO | AAs of VL | AAs of VL CDR1 | AAs of VL CDR2 | AAs of VL CDR3 | AAs of VH | AAs of VH CDR1 | AAs of VH CDR2 | AAs of VH CDR3 | VH CDR3 Sequence (SEQ ID NO) |
|---|---|---|---|---|---|---|---|---|---|---|
| I076F08 | 1548 | 140–250 | 164–174 | 190–196 | 229–239 | 1–124 | 26–36 | 51–66 | 99–113 | VHYDILTGYLWAFDI (SEQ ID NO: 2730) |
| I076F10 | 1549 | 140–252 | 163–175 | 191–197 | 230–241 | 1–124 | 26–34 | 49–65 | 98–113 | ELGLSIVGATTGALDM (SEQ ID NO: 2174) |
| I076G09 | 1550 | 133–245 | 156–168 | 184–190 | 223–234 | 1–117 | 26–35 | 50–66 | 99–106 | DQGRYLDL (SEQ ID NO: 2175) |
| I076G10 | 1551 | 140–251 | 163–175 | 191–197 | 230–240 | 1–124 | 26–35 | 50–66 | 99–113 | GRYYDMLTRGGYFDY (SEQ ID NO: 2858) |
| I076G11 | 1552 | 143–259 | 166–179 | 195–205 | 240–248 | 1–127 | 26–35 | 50–66 | 99–116 | GTGYDILTGYYMGSAFDQ (SEQ ID NO: 2800) |
| I076G12 | 1553 | 146–257 | 169–181 | 197–203 | 236–246 | 1–130 | 26–35 | 50–66 | 99–119 | NGYYDILTGYYLWDYYYGMDV (SEQ ID NO: 2769) |
| I076H02 | 1554 | 140–251 | 163–175 | 191–197 | 230–240 | 1–124 | 26–35 | 50–66 | 99–113 | ENYDSLTGYYNYFDY (SEQ ID NO: 2971) |
| I076H04 | 1555 | 141–251 | 165–175 | 191–197 | 230–240 | 1–125 | 26–35 | 50–66 | 99–114 | THYDILTGYYSHPLDY (SEQ ID NO: 2863) |
| I076H05 | 1556 | 140–251 | 163–175 | 191–197 | 230–240 | 1–124 | 26–34 | 49–65 | 98–113 | ELGLSIVGATTGALDM (SEQ ID NO: 2174) |
| I076H06 | 1557 | 140–252 | 163–176 | 192–198 | 231–241 | 1–124 | 26–35 | 50–66 | 99–113 | VPYDILTGYWGAFDV (SEQ ID NO: 2827) |
| I076H09 | 1558 | 143–256 | 166–179 | 195–201 | 234–245 | 1–127 | 26–35 | 50–66 | 99–116 | GSGYDLLTGYFTGSPLDY (SEQ ID NO: 2766) |
| I076H10 | 1559 | 143–256 | 166–179 | 195–201 | 234–245 | 1–127 | 26–35 | 50–66 | 99–116 | GSGYDLLTGYFTGSPLDY (SEQ ID NO: 2766) |
| I077D06 | 1560 | 140–250 | 162–175 | 191–197 | 230–239 | 1–124 | 26–35 | 50–66 | 99–113 | VYYDILTGYNLFFDY (SEQ ID NO: 2177) |
| I078B04 | 1561 | 140–250 | 162–175 | 191–197 | 230–239 | 1–124 | 26–35 | 50–66 | 99–113 | VYYDILTGYNLFFDY (SEQ ID NO: 2177) |
| I078E10 | 1562 | 141–251 | 163–176 | 192–198 | 231–240 | 1–125 | 26–35 | 50–66 | 99–114 | MEYDILTGYYGGYFDY (SEQ ID NO: 2179) |
| I002A01-K | 1563 | 141–250 | 164–174 | 190–196 | 229–239 | 1–125 | 26–35 | 50–66 | 99–114 | ELGLSIVGATTGALDM (SEQ ID NO: 2174) |
| I002A01-R | 1564 | 141–250 | 164–174 | 190–196 | 229–239 | 1–125 | 26–35 | 50–66 | 99–114 | ELGLSIVGATTGALDM (SEQ ID NO: 2174) |
| I026C04-K | 1565 | 141–250 | 164–176 | 192–198 | 231–239 | 1–125 | 26–35 | 50–66 | 99–114 | ELGLSIVGATTGALDM (SEQ ID NO: 2174) |
| I026C04-R | 1566 | 141–250 | 164–176 | 192–198 | 231–239 | 1–125 | 26–35 | 50–66 | 99–114 | ELGLSIVGATTGALDM (SEQ ID NO: 2174) |
| I067B10 | 1567 | 149–259 | 171–183 | 199–205 | 238–248 | 1–133 | 26–35 | 50–66 | 99–122 | DRGAPNYDILTGYYAPAQGVAFDI (SEQ ID NO: 2176) |
| I068C06 | 1568 | 133–244 | 156–169 | 185–191 | 224–233 | 1–117 | 26–35 | 50–66 | 99–106 | DQGRYLDL (SEQ ID NO: 2175) |
| I075F12 | 1569 | 133–244 | 156–168 | 184–190 | 223–233 | 1–117 | 26–35 | 50–66 | 99–106 | DQGRYLDL (SEQ ID NO: 2175) |
| I003C06 | 1570 | 140–249 | 163–173 | 189–195 | 228–238 | 1–124 | 26–34 | 49–65 | 98–113 | ELGLSIVGATTGALDM (SEQ ID NO: 2174) |
| I025B06 | 1571 | 140–249 | 163–175 | 191–197 | 230–238 | 1–124 | 26–34 | 49–65 | 98–113 | ELGLSIVGATTGALDM (SEQ ID NO: 2174) |
| I025B09 | 1572 | 140–249 | 163–175 | 191–197 | 230–238 | 1–124 | 26–34 | 49–65 | 98–113 | ELGLSIVGATTGALDM (SEQ ID NO: 2174) |
| I026C04 | 1573 | 140–249 | 163–175 | 191–197 | 230–238 | 1–124 | 26–34 | 49–65 | 98–113 | ELGLSIVGATTGALDM (SEQ ID NO: 2174) |
| I027B12 | 1574 | 141–250 | 164–174 | 190–196 | 229–239 | 1–125 | 26–34 | 49–65 | 99–114 | ELGLSIVGATTGALDM (SEQ ID NO: 2174) |
| I030A10 | 1575 | 140–252 | 163–176 | 192–198 | 231–241 | 1–124 | 26–34 | 49–65 | 98–113 | ELGLSIVGATTGALDM (SEQ ID NO: 2174) |
| I064C04 | 1576 | 147–257 | 169–182 | 198–204 | 237–246 | 1–131 | 26–35 | 50–66 | 99–120 | DGRLSYDILTGYYARDYYGMDD (SEQ ID NO: 2188) |
| I064C07 | 1577 | 134–241 | 157–167 | 183–189 | 222–230 | 1–118 | 26–35 | 50–66 | 99–107 | SEGTIFGVD (SEQ ID NO: 2178) |
| I065D04 | 1578 | 144–254 | 166–179 | 195–201 | 234–243 | 1–128 | 26–36 | 51–66 | 99–117 | GKGYYDILTGYYRDNWFDP (SEQ ID NO: 2181) |
| I065D08 | 1579 | 147–257 | 169–182 | 198–204 | 237–246 | 1–131 | 26–35 | 50–66 | 99–120 | TPSSVYDLLTGYYHYFYSYMDV (SEQ ID NO: 2189) |
| I065F08 | 1580 | 135–242 | 158–168 | 184–190 | 223–231 | 1–119 | 26–35 | 50–66 | 99–108 | EKSAAGYFDY (SEQ ID NO: 2190) |
| I067F05 | 1581 | 140–250 | 162–175 | 191–197 | 230–239 | 1–124 | 26–35 | 50–66 | 99–113 | ENYDSLTGYYGAFDI (SEQ ID NO: 2185) |
| I068B04 | 1582 | 133–244 | 156–168 | 184–190 | 223–233 | 1–117 | 26–35 | 50–66 | 99–106 | DQGRYLDL (SEQ ID NO: 2175) |
| I068B08 | 1583 | 140–252 | 163–175 | 191–197 | 231–241 | 1–124 | 26–34 | 49–65 | 98–113 | KLGLSIVGATTGALDM (SEQ ID NO: 2186) |
| I068C08 | 1584 | 142–254 | 165–178 | 194–200 | 233–243 | 1–126 | 26–35 | 50–66 | 99–115 | EGMNDFINSHHYYTMDA (SEQ ID NO: 2182) |
| I068F03 | 1585 | 139–251 | 162–175 | 191–197 | 230–240 | 1–123 | 26–35 | 50–66 | 99–112 | AGNEYGHTERPADY (SEQ ID NO: 2180) |
| I069B07 | 1586 | 141–251 | 163–176 | 192–198 | 231–240 | 1–125 | 26–35 | 50–66 | 99–114 | MEYDILTGYYGGYFDY (SEQ ID NO: 2179) |
| I071B03 | 1587 | 141–251 | 163–176 | 192–198 | 231–240 | 1–125 | 26–35 | 50–66 | 99–114 | ATYDPLTGYSFDGFDI (SEQ ID NO: 2153) |
| I072B09 | 1588 | 141–248 | 162–172 | 188–194 | 227–237 | 1–125 | 26–35 | 50–66 | 99–114 | ATYDPLTGYSFDGFDI (SEQ ID NO: 2153) |
| I073F04 | 1589 | 136–246 | 158–171 | 187–193 | 226–235 | 1–120 | 26–35 | 50–66 | 99–109 | SLATRPLGMDV (SEQ ID NO: 2184) |
| I074B12 | 1590 | 140–252 | 164–176 | 192–198 | 231–241 | 1–124 | 26–34 | 49–65 | 98–113 | ELGLSIVGATTGALDM (SEQ ID NO: 2174) |
| I075A02 | 1591 | 140–251 | 163–175 | 191–197 | 230–240 | 1–124 | 26–34 | 49–65 | 98–113 | ELGLSIVGATTGALDM (SEQ ID NO: 2174) |
| I075G01 | 1592 | 140–251 | 164–174 | 190–196 | 229–240 | 1–124 | 26–35 | 50–66 | 99–113 | DHFDTLTGYFRRLDS (SEQ ID NO: 2187) |
| I078D02 | 1593 | 140–250 | 162–175 | 191–197 | 230–239 | 1–124 | 26–35 | 50–66 | 99–113 | VYYDILTGYNLFFDY (SEQ ID NO: 2177) |

TABLE 1-continued scFvs that Immunospecifically Bind to BLyS

| Clone ID | scFv SEQ ID NO | AAs of VL | AAs of VL CDR1 | AAs of VL CDR2 | AAs of VL CDR3 | AAs of VH | AAs of VH CDR1 | AAs of VH CDR2 | AAs of VH CDR3 | VH CDR3 Sequence (SEQ ID NO) |
|---|---|---|---|---|---|---|---|---|---|---|
| I078D08 | 1594 | 144–251 | 165–175 | 191–197 | 230–240 | 1–128 | 26–35 | 50–66 | 99–117 | DAQSYYDILTGYQSYAFDI (SEQ ID NO: 2183) |
| I078H08 | 1595 | 140–250 | 162–175 | 191–197 | 230–239 | 1–124 | 26–35 | 50–66 | 99–113 | VYYDILTGYNLFFDY (SEQ ID NO: 2177) |
| I064A03 | 1596 | 150–257 | 171–181 | 197–203 | 236–246 | 1–134 | 26–35 | 50–66 | 99–123 | GPSTTYYDILTGYYTPYYYYYYMDV (SEQ ID NO: 3014) |
| I064B03 | 1597 | 145–255 | 167–179 | 195–201 | 234–244 | 1–129 | 26–37 | 52–67 | 100–118 | HVRDYDILTGYYRGHYFDY (SEQ ID NO: 2167) |
| I064B05 | 1598 | 140–250 | 162–174 | 190–196 | 229–239 | 1–124 | 26–35 | 50–66 | 99–113 | ERGVVTAYGGDSFDL (SEQ ID NO: 2985) |
| I064B11 | 1599 | 138–248 | 160–173 | 189–195 | 228–237 | 1–122 | 26–35 | 50–66 | 99–111 | DRGPGLLSSFFES (SEQ ID NO: 3033) |
| I064C02 | 1600 | 146–256 | 168–180 | 196–202 | 235–245 | 1–130 | 26–35 | 50–66 | 99–119 | DEYYDILTGYQAPYYYYGMDV (SEQ ID NO: 3068) |
| I064C03 | 1601 | 140–250 | 162–175 | 191–197 | 230–239 | 1–124 | 26–35 | 50–66 | 99–113 | ERGVVTAYGGDSFDL (SEQ ID NO: 2985) |
| I064C11 | 1602 | 143–253 | 165–178 | 194–200 | 233–242 | 1–127 | 26–35 | 50–65 | 98–116 | DVTYHDILTGYAGHEAFDI (SEQ ID NO: 3055) |
| I064C12 | 1603 | 148–255 | 171–181 | 197–203 | 236–244 | 1–132 | 26–37 | 52–69 | 102–12 1 | ESGRYDILTGYYSGGGGMDV (SEQ ID NO: 3012) |
| I064D03 | 1604 | 146–256 | 168–181 | 197–203 | 236–245 | 1–130 | 26–35 | 50–66 | 99–119 | DGANYDILTGYYTTTVYGMDV (SEQ ID NO: 3072) |
| I064D04 | 1605 | 141–251 | 163–176 | 192–198 | 231–240 | 1–125 | 26–35 | 50–66 | 99–114 | RSYDILTGYYTYGMDV (SEQ ID NO: 3090) |
| I064D06 | 1606 | 134–244 | 156–169 | 185–191 | 224–233 | 1–118 | 26–35 | 50–66 | 99–107 | EGSSGYLVG (SEQ ID NO: 2981) |
| I064E05 | 1607 | 146–256 | 168–180 | 196–202 | 235–245 | 1–130 | 26–37 | 52–67 | 100–119 | KQRGDYDILTGYQLGYAFDI (SEQ ID NO: 2808) |
| I064E06 | 1608 | 145–255 | 167–180 | 196–202 | 235–244 | 1–129 | 26–35 | 50–66 | 99–118 | ERPGYDILTGYPSSIYGMDV (SEQ ID NO: 3053) |
| I064F07 | 1609 | 141–248 | 162–172 | 188–194 | 227–237 | 1–125 | 26–35 | 50–66 | 99–114 | ATYDPLTGYSFDGFDI (SEQ ID NO: 2153) |
| I064F09 | 1610 | 147–257 | 169–181 | 197–203 | 236–246 | 1–131 | 26–35 | 50–66 | 99–120 | DTLGYDILTGYPPPYYYYDMDV (SEQ ID NO: 2988) |
| I064F10 | 1611 | 143–253 | 165–177 | 193–199 | 232–242 | 1–127 | 22–31 | 46–62 | 95–116 | DTLGYDILTGYPPPYYYYDMDV (SEQ ID NO: 2988) |
| I064F11 | 1612 | 142–252 | 164–177 | 193–199 | 232–241 | 1–126 | 26–35 | 50–65 | 98–115 | GRHYYDILTGYYNEAFDI (SEQ ID NO: 3031) |
| I064G01 | 1613 | 140–250 | 162–175 | 191–197 | 230–239 | 1–124 | 26–35 | 50–66 | 99–113 | NYYDVLTQSYYGMDV (SEQ ID NO: 3077) |
| I064G04 | 1614 | 133–243 | 155–167 | 183–189 | 222–232 | 1–117 | 26–35 | 50–66 | 99–106 | DNSGTYGY (SEQ ID NO: 3084) |
| I064G08 | 1615 | 138–245 | 159–169 | 185–191 | 224–234 | 1–122 | 26–35 | 50–66 | 99–111 | GGVTAGRSVYFDS (SEQ ID NO: 2990) |
| I064G10 | 1616 | 140–250 | 162–175 | 191–197 | 230–239 | 1–124 | 26–35 | 50–66 | 99–113 | SPNGDYSGYAWGLEY (SEQ ID NO: 3085) |
| I064G11 | 1617 | 138–248 | 160–173 | 189–195 | 228–237 | 1–122 | 26–35 | 50–65 | 98–111 | YFDGSGYYPVSFSY (SEQ ID NO: 3064) |
| I064G12 | 1618 | 139–249 | 161–173 | 189–195 | 228–238 | 1–123 | 26–35 | 50–65 | 98–112 | VNYDILTGLGYYFDY (SEQ ID NO: 3049) |
| I064H03 | 1619 | 143–253 | 165–178 | 194–200 | 233–242 | 1–127 | 26–37 | 52–67 | 100–116 | SYYDILTGRPYTDAFDI (SEQ ID NO: 2989) |
| I064H04 | 1620 | 142–249 | 163–173 | 189–195 | 228–238 | 1–126 | 26–35 | 50–66 | 99–115 | PLGITAVRGAKTDAFGI (SEQ ID NO: 2929) |
| I064H06 | 1621 | 149–256 | 170–180 | 196–202 | 235–245 | 1–133 | 26–35 | 50–66 | 99–122 | DRGASNYDILTGYYAPAQGVAFDI (SEQ ID NO: 2969) |
| I065A02 | 1622 | 141–248 | 162–172 | 188–194 | 227–237 | 1–125 | 26–35 | 50–66 | 99–114 | ATYDPLTGYSFDGFDI (SEQ ID NO: 2153) |
| I065A04 | 1623 | 141–248 | 162–172 | 188–194 | 227–237 | 1–125 | 26–35 | 50–66 | 99–114 | ATYDPLTGYSFDGFDI (SEQ ID NO: 2153) |
| I065A06 | 1624 | 141–248 | 162–172 | 188–194 | 227–237 | 1–125 | 26–35 | 50–66 | 99–114 | ATYDPLTGYSFDGFDI (SEQ ID NO: 2153) |
| I065A07 | 1625 | 144–254 | 166–179 | 195–201 | 234–243 | 1–128 | 26–35 | 50–66 | 99–117 | DGGGYDILTGYQYYYGMDV (SEQ ID NO: 2987) |
| I065B01 | 1626 | 145–255 | 167–180 | 196–202 | 235–244 | 1–129 | 26–35 | 50–65 | 98–118 | WATYYDTLTGYRLKDHAGFDI (SEQ ID NO: 3017) |
| I065B05 | 1627 | 142–252 | 164–177 | 193–199 | 232–241 | 1–126 | 26–35 | 50–66 | 99–115 | SPGDDILTGYYKYYFDY (SEQ ID NO: 3032) |
| I065B09 | 1628 | 146–253 | 167–177 | 193–199 | 232–242 | 1–130 | 26–35 | 50–66 | 99–119 | DAGESYDILTGYYVIEGYMDV (SEQ ID NO: 2986) |
| I065B12 | 1629 | 139–249 | 161–174 | 190–196 | 229–238 | 1–123 | 26–35 | 50–66 | 99–112 | EGAADYLNGQYFQH (SEQ ID NO: 2815) |
| I065C02 | 1630 | 136–246 | 158–170 | 186–192 | 225–235 | 1–120 | 26–35 | 50–66 | 99–109 | EGSWSGLDLDY (SEQ ID NO: 3007) |
| I065C06 | 1631 | 141–253 | 163–175 | 191–197 | 230–242 | 1–125 | 26–35 | 50–66 | 99–114 | ATYDPLTGYSFDGFDI (SEQ ID NO: 2153) |
| I065C08 | 1632 | 141–250 | 163–176 | 192–198 | 231–239 | 1–125 | 26–35 | 50–66 | 99–114 | VSGYNSGYFESYDMDV (SEQ ID NO: 2732) |
| I065C10 | 1633 | 137–247 | 159–172 | 188–194 | 227–236 | 1–121 | 26–35 | 50–66 | 99–110 | QGGQYDSPPLDV (SEQ ID NO: 3002) |
| I065D01 | 1634 | 142–252 | 164–177 | 193–199 | 232–241 | 1–126 | 26–35 | 50–66 | 99–115 | DRDYDILTDYSNYGMDV (SEQ ID NO: 3074) |
| I065D03 | 1635 | 142–249 | 165–175 | 191–197 | 230–238 | 1–126 | 26–35 | 50–66 | 99–115 | APLYDILTGYYIGGNDY (SEQ ID NO: 3028) |
| I065D05 | 1636 | 143–253 | 165–178 | 194–200 | 233–242 | 1–127 | 26–35 | 50–66 | 99–116 | DKDYDILTGYWRDELLDY (SEQ ID NO: 3040) |
| I065D06 | 1637 | 142–252 | 164–177 | 193–199 | 232–241 | 1–126 | 26–35 | 50–66 | 99–115 | DPNYDILTGYYYYAMDV (SEQ ID NO: 3062) |
| I065E01 | 1638 | 139–246 | 160–170 | 186–192 | 225–235 | 1–123 | 26–35 | 50–66 | 99–112 | EFDQLLARGHGMDV (SEQ ID NO: 3027) |
| I065E05 | 1639 | 137–244 | 158–168 | 184–190 | 223–233 | 1–121 | 26–35 | 50–66 | 99–110 | AGSSLMTYGTDV (SEQ ID NO: 2773) |

TABLE 1-continued scFvs that Immunospecifically Bind to BLyS

| Clone ID | scFv SEQ ID NO | AAs of VL | AAs of VL CDR1 | AAs of VL CDR2 | AAs of VL CDR3 | AAs of VH | AAs of VH CDR1 | AAs of VH CDR2 | AAs of VH CDR3 | VH CDR3 Sequence (SEQ ID NO) |
|---|---|---|---|---|---|---|---|---|---|---|
| I065E06 | 1640 | 146–256 | 168–181 | 197–203 | 236–245 | 1–130 | 26–35 | 50–66 | 99–119 | ARGSYDILTGYYRPGDGYFDY (SEQ ID NO: 3043) |
| I065E08 | 1641 | 142–249 | 163–173 | 189–195 | 228–238 | 1–126 | 26–35 | 50–66 | 99–115 | GLYFEDTNYRHGDAFDI (SEQ ID NO: 2790) |
| I065E09 | 1642 | 145–255 | 167–179 | 195–201 | 234–244 | 1–129 | 26–35 | 50–65 | 98–118 | ERSYYDILTGYSPRSKYGMDV (SEQ ID NO: 3021) |
| I065E12 | 1643 | 141–248 | 162–172 | 188–194 | 227–237 | 1–125 | 26–35 | 50–66 | 99–114 | ATYDPLTGYSFDGFDI (SEQ ID NO: 2153) |
| I065F04 | 1644 | 140–250 | 162–175 | 191–197 | 230–239 | 1–124 | 26–35 | 50–66 | 99–113 | ERGVVTAYGGDSFDL (SEQ ID NO: 2985) |
| I065F05 | 1645 | 140–250 | 162–175 | 191–197 | 230–239 | 1–124 | 26–35 | 50–65 | 98–113 | RYSDALTGYSLGAFDV (SEQ ID NO: 3018) |
| I065F07 | 1646 | 145–252 | 166–176 | 192–198 | 231–241 | 1–129 | 26–38 | 53–69 | 102–118 | GAYYDILTGYYPYGMDV (SEQ ID NO: 2860) |
| I065F09 | 1647 | 143–250 | 164–174 | 190–196 | 229–239 | 1–127 | 26–35 | 50–66 | 99–116 | DYPIDVLTGRRTKNWFDP (SEQ ID NO: 3013) |
| I065F12 | 1648 | 141–248 | 162–172 | 188–194 | 227–237 | 1–125 | 26–35 | 50–66 | 99–114 | DQVDRLLMQYNYYMDA (SEQ ID NO: 3047) |
| I065G01 | 1649 | 141–251 | 163–176 | 192–198 | 231–240 | 1–125 | 26–35 | 50–66 | 99–114 | ATYDPLTGYSFDGFDI (SEQ ID NO: 2153) |
| I065G09 | 1650 | 143–253 | 165–178 | 194–200 | 233–242 | 1–127 | 26–35 | 50–68 | 101–116 | DAYYDILTGWVYGMDV (SEQ ID NO: 3030) |
| I065G10 | 1651 | 140–247 | 161–171 | 187–193 | 226–236 | 1–124 | 26–36 | 51–66 | 99–113 | FRYDILTGYYYDMDV (SEQ ID NO: 2983) |
| I065H05 | 1652 | 140–247 | 161–171 | 187–193 | 226–236 | 1–124 | 26–35 | 50–66 | 99–113 | EYYDILTGYSGAFDI (SEQ ID NO: 2984) |
| I065H07 | 1653 | 138–248 | 160–173 | 189–195 | 228–237 | 1–122 | 26–35 | 50–66 | 99–111 | TRMDVLTRYYSDF (SEQ ID NO: 2750) |
| I066A05 | 1654 | 137–247 | 159–172 | 188–194 | 227–236 | 1–121 | 26–35 | 50–66 | 99–110 | AGSSLMTYGTDV (SEQ ID NO: 2773) |
| I066A06 | 1655 | 139–246 | 160–170 | 186–192 | 225–235 | 1–123 | 26–35 | 50–66 | 99–112 | EGAADYLNGQYFQH (SEQ ID NO: 2815) |
| I066A12 | 1656 | 142–252 | 164–177 | 193–199 | 232–241 | 1–126 | 26–35 | 50–66 | 99–115 | DTRVIGIQLWERGAFDM (SEQ ID NO: 3080) |
| I066B05 | 1657 | 141–248 | 162–172 | 188–194 | 227–237 | 1–125 | 26–35 | 50–66 | 99–114 | ATYDPLTGYSFDGFDI (SEQ ID NO: 2153) |
| I066B11 | 1658 | 142–252 | 164–177 | 193–199 | 232–241 | 1–126 | 26–35 | 50–66 | 99–115 | PLGITAVRGAKTDAFGI (SEQ ID NO: 2929) |
| I066C06 | 1659 | 144–254 | 166–178 | 194–200 | 233–243 | 1–128 | 26–35 | 50–65 | 98–117 | GRRYYDILTGYSLGRGEMDV (SEQ ID NO: 3009) |
| I066C10 | 1660 | 141–248 | 162–172 | 188–194 | 227–237 | 1–125 | 26–35 | 50–66 | 99–114 | ATYDPLTGYSFDGFDI (SEQ ID NO: 2153) |
| I066D02 | 1661 | 137–247 | 159–172 | 188–194 | 227–236 | 1–121 | 26–35 | 50–66 | 99–110 | AGTSLMNYGTDV (SEQ ID NO: 3048) |
| I066D07 | 1662 | 141–248 | 162–172 | 188–194 | 227–237 | 1–125 | 26–35 | 50–66 | 99–114 | GPYDVLTGYLSGNFDY (SEQ ID NO: 2992) |
| I066E01 | 1663 | 137–247 | 159–172 | 188–194 | 227–236 | 1–121 | 26–35 | 50–66 | 99–110 | QGGQYDSPPFDV (SEQ ID NO: 3001) |
| I066E03 | 1664 | 149–259 | 171–184 | 200–206 | 239–248 | 1–133 | 26–35 | 50–66 | 99–122 | GEKARYYDILTGYYSAWGGYYMDV (SEQ ID NO: 3045) |
| I066E04 | 1665 | 141–248 | 162–172 | 188–194 | 227–237 | 1–125 | 26–35 | 50–66 | 99–114 | LNLEKTVIRGFGYFDL (SEQ ID NO: 3081) |
| I066E05 | 1666 | 142–252 | 164–177 | 193–199 | 232–241 | 1–126 | 26–35 | 50–66 | 99–115 | VGGYDILTGYYLRGMDV (SEQ ID NO: 2997) |
| I066E07 | 1667 | 141–248 | 162–172 | 188–194 | 227–237 | 1–125 | 26–35 | 50–66 | 99–114 | ATYDPLTGYSFDGFDI (SEQ ID NO: 2153) |
| I066E09 | 1668 | 141–248 | 162–172 | 188–194 | 227–237 | 1–125 | 26–35 | 50–66 | 99–114 | ATYDPLTGYSFDGFDI (SEQ ID NO: 2153) |
| I066F01 | 1669 | 141–251 | 163–176 | 192–198 | 231–240 | 1–125 | 26–35 | 50–66 | 99–114 | SPYDTLTGYVYNGVDV (SEQ ID NO: 3058) |
| I066F03 | 1670 | 141–248 | 162–172 | 188–194 | 227–237 | 1–125 | 26–35 | 50–66 | 99–114 | ATYDPLTGYSFDGFDI (SEQ ID NO: 2153) |
| I066F04 | 1671 | 141–251 | 163–175 | 191–197 | 230–240 | 1–125 | 26–35 | 50–66 | 99–114 | VAAAGARTLGYFGMDV (SEQ ID NO: 3071) |
| I066F07 | 1672 | 143–253 | 165–178 | 194–200 | 233–242 | 1–127 | 26–35 | 50–66 | 99–116 | DVSGHDILTGYSYRYFDV (SEQ ID NO: 2795) |
| I066F08 | 1673 | 144–254 | 166–179 | 195–201 | 234–243 | 1–128 | 26–35 | 50–66 | 99–117 | SPMYYDRLTGFYPSGYFDS (SEQ ID NO: 3036) |
| I066F11 | 1674 | 142–252 | 164–177 | 193–199 | 232–241 | 1–126 | 26–35 | 50–66 | 99–115 | GAYYDILTGYYPYGMDV (SEQ ID NO: 2860) |
| I066F12 | 1675 | 141–248 | 162–172 | 188–194 | 227–237 | 1–125 | 26–35 | 50–66 | 99–114 | GPSSAGTTIGLGSFDP (SEQ ID NO: 3005) |
| I066G06 | 1676 | 143–250 | 164–174 | 190–196 | 229–239 | 1–127 | 26–35 | 50–66 | 99–116 | ETRKYTSSPPYNYYYMDV (SEQ ID NO: 2736) |
| I066G07 | 1677 | 133–243 | 155–168 | 184–190 | 223–232 | 1–117 | 26–30 | 45–61 | 94–106 | DQFSVGGRHAFDL (SEQ ID NO: 3054) |
| I066H02 | 1678 | 135–242 | 156–166 | 182–188 | 221–231 | 1–119 | 26–35 | 50–66 | 99–108 | GMGDHYGMDV (SEQ ID NO: 2161) |
| I067A02 | 1679 | 141–248 | 162–172 | 188–194 | 227–237 | 1–125 | 26–35 | 50–66 | 99–114 | ATYDPLTGYSFDGFDI (SEQ ID NO: 2153) |
| I067A03 | 1680 | 137–247 | 159–172 | 188–194 | 227–236 | 1–121 | 26–35 | 50–66 | 99–110 | AGSSLMTYGTDV (SEQ ID NO: 2773) |
| I067A06 | 1681 | 141–248 | 162–172 | 188–194 | 227–237 | 1–125 | 26–35 | 50–66 | 99–114 | ATYDPLTGYSFDGFDI (SEQ ID NO: 2153) |
| I067A08 | 1682 | 137–247 | 159–171 | 187–193 | 226–236 | 1–121 | 26–35 | 50–66 | 99–110 | AGSSLMTYGTDV (SEQ ID NO: 2773) |
| I067A10 | 1683 | 140–250 | 162–175 | 191–197 | 230–239 | 1–124 | 26–35 | 50–66 | 99–113 | ERGVVTAYGGDSFDL (SEQ ID NO: 2985) |
| I067B03 | 1684 | 142–253 | 164–177 | 193–199 | 232–242 | 1–126 | 26–35 | 50–66 | 99–115 | PLGITAVRGAKTDAFGI (SEQ ID NO: 2929) |
| I067B04 | 1685 | 137–247 | 159–172 | 188–194 | 227–236 | 1–121 | 26–35 | 50–66 | 99–110 | AGSSLMTYGTDV (SEQ ID NO: 2773) |

TABLE 1-continued scFvs that Immunospecifically Bind to BLyS

| Clone ID | scFv SEQ ID NO | AAs of VL | AAs of VL CDR1 | AAs of VL CDR2 | AAs of VL CDR3 | AAs of VH | AAs of VH CDR1 | AAs of VH CDR2 | AAs of VH CDR3 | VH CDR3 Sequence (SEQ ID NO) |
|---|---|---|---|---|---|---|---|---|---|---|
| I067C03 | 1686 | 133–244 | 156–169 | 185–191 | 224–233 | 1–117 | 26–35 | 50–66 | 99–106 | DWGHWFDP (SEQ ID NO: 2982) |
| I067C05 | 1687 | 137–247 | 159–172 | 188–194 | 227–236 | 1–121 | 26–35 | 50–66 | 99–110 | SGSSLMTYGTDV (SEQ ID NO: 3015) |
| I067C07 | 1688 | 141–251 | 163–176 | 192–198 | 231–240 | 1–125 | 26–35 | 50–66 | 99–114 | EPYDILTGYYGSYFDY (SEQ ID NO: 3041) |
| I067C10 | 1689 | 137–247 | 159–172 | 188–194 | 227–236 | 1–121 | 26–35 | 50–66 | 99–110 | AGSSLMTYGTDV (SEQ ID NO: 2773) |
| I067C12 | 1690 | 142–252 | 164–177 | 193–199 | 232–241 | 1–126 | 26–35 | 50–66 | 99–115 | TYYDILTGYSGGGAFDY (SEQ ID NO: 3024) |
| I067D01 | 1691 | 136–246 | 158–171 | 187–193 | 226–235 | 1–120 | 26–35 | 50–66 | 99–109 | GSRVRGVTPDL (SEQ ID NO: 3020) |
| I067D03 | 1692 | 137–244 | 158–168 | 184–190 | 223–233 | 1–121 | 26–35 | 50–66 | 99–110 | AGSSLMTYGTDV (SEQ ID NO: 2773) |
| I067D05 | 1693 | 146–256 | 168–180 | 196–202 | 235–245 | 1–130 | 26–35 | 50–66 | 99–119 | ECSGSSCPARQPPYYQYYMDV (SEQ ID NO: 2993) |
| I067D06 | 1694 | 137–244 | 158–168 | 184–190 | 223–233 | 1–121 | 26–35 | 50–66 | 99–110 | AGSSLMTYGTDV (SEQ ID NO: 2773) |
| I067D09 | 1695 | 142–252 | 164–177 | 193–199 | 232–241 | 1–126 | 26–35 | 50–66 | 99–115 | GAYYDILTGYYPYGMDV (SEQ ID NO: 2860) |
| I067D12 | 1696 | 137–247 | 159–172 | 188–194 | 227–236 | 1–121 | 26–35 | 50–66 | 99–110 | QGGQYDSPPLDV (SEQ ID NO: 3002) |
| I067E02 | 1697 | 137–247 | 159–172 | 188–194 | 227–236 | 1–121 | 26–35 | 50–66 | 99–110 | AGSSLMTYGTDV (SEQ ID NO: 2773) |
| I067E04 | 1698 | 142–252 | 164–176 | 192–198 | 231–241 | 1–126 | 26–35 | 50–66 | 99–115 | GAYYDILTGYYPYGMDV (SEQ ID NO: 2860) |
| I067E05 | 1699 | 144–254 | 166–179 | 195–201 | 234–243 | 1–128 | 26–35 | 50–66 | 99–117 | DYRNYDILTGHPYYYGMDV (SEQ ID NO: 2996) |
| I067F01 | 1700 | 141–248 | 164–174 | 190–196 | 229–237 | 1–125 | 26–35 | 50–66 | 99–114 | QHYDILTGYSQEPFDI (SEQ ID NO: 3022) |
| I067F03 | 1701 | 144–254 | 166–179 | 195–201 | 234–243 | 1–128 | 26–35 | 50–66 | 99–117 | DQTYYDILTGHYYYYGMDV (SEQ ID NO: 3087) |
| I067F04 | 1702 | 139–246 | 160–170 | 186–192 | 225–235 | 1–123 | 26–35 | 50–66 | 99–112 | EGAADYLNGQYFQH (SEQ ID NO: 2815) |
| I067F08 | 1703 | 140–247 | 161–171 | 187–193 | 226–236 | 1–124 | 26–35 | 50–66 | 99–113 | LGYYDILTGYRSDDY (SEQ ID NO: 3029) |
| I067F10 | 1704 | 137–247 | 159–172 | 188–194 | 227–236 | 1–121 | 26–35 | 50–66 | 99–110 | AGSSLMAYGTDV (SEQ ID NO: 3016) |
| I067F11 | 1705 | 140–248 | 161–171 | 187–193 | 226–237 | 1–124 | 26–35 | 50–66 | 99–113 | ENYDFLTGYYGAFDI (SEQ ID NO: 2772) |
| I067G01 | 1706 | 141–251 | 163–176 | 192–198 | 231–240 | 1–125 | 26–35 | 50–66 | 99–114 | ATYDPLTGYSFDGFDI (SEQ ID NO: 2153) |
| I067G09 | 1707 | 137–247 | 159–171 | 187–193 | 226–236 | 1–121 | 26–35 | 50–66 | 99–110 | AGSSLMTYGTDV (SEQ ID NO: 2773) |
| I067H07 | 1708 | 144–251 | 165–175 | 191–197 | 230–240 | 1–128 | 26–35 | 50–66 | 99–117 | GGLYDILTGRPATDDAFDI (SEQ ID NO: 3035) |
| I068A07 | 1709 | 142–254 | 165–178 | 194–200 | 233–243 | 1–126 | 26–35 | 50–66 | 99–115 | TDRFGAKDVTARWGMDV (SEQ ID NO: 2979) |
| I068E05 | 1710 | 147–257 | 170–183 | 199–205 | 238–246 | 1–131 | 26–35 | 50–66 | 99–120 | GREDTDKVKPWDRYYHYYYMDV (SEQ ID NO: 2809) |
| I068E08 | 1711 | 133–247 | 157–169 | 185–193 | 226–236 | 1–117 | 26–35 | 50–66 | 99–106 | DQGRYLDL (SEQ ID NO: 2175) |
| I068E11 | 1712 | 140–251 | 163–176 | 192–198 | 231–240 | 1–124 | 26–34 | 49–65 | 98–113 | ELGLSIVGATTGALDM (SEQ ID NO: 2174) |
| I068F04 | 1713 | 141–252 | 164–176 | 192–198 | 231–241 | 1–125 | 26–35 | 50–66 | 99–114 | ELGHREGGYWYSPYNV (SEQ ID NO: 2838) |
| I068G05 | 1714 | 135–245 | 159–169 | 185–191 | 224–234 | 1–119 | 26–35 | 50–66 | 98–108 | KNMGASAAADF (SEQ ID NO: 3042) |
| I068G06 | 1715 | 139–250 | 162–174 | 190–196 | 229–239 | 1–123 | 26–35 | 50–66 | 99–112 | RYGDPFYYYYYMNV (SEQ ID NO: 2755) |
| I068G11 | 1716 | 146–258 | 169–182 | 198–204 | 237–247 | 1–130 | 26–35 | 50–66 | 99–119 | ESGSHYDLLTGLLVAANGFDV (SEQ ID NO: 3044) |
| I069A09 | 1717 | 141–248 | 164–174 | 190–196 | 229–237 | 1–125 | 26–35 | 50–66 | 99–114 | MEYDILTGYYGGYFDY (SEQ ID NO: 2179) |
| I069A10 | 1718 | 141–248 | 162–172 | 188–194 | 227–237 | 1–125 | 26–35 | 50–66 | 99–114 | MEYDILTGYYGGYFDY (SEQ ID NO: 2179) |
| I069B06 | 1719 | 141–248 | 164–174 | 190–196 | 229–237 | 1–125 | 26–35 | 50–66 | 99–114 | MEYDILTGYYGGYFDY (SEQ ID NO: 2179) |
| I069B09 | 1720 | 139–249 | 161–174 | 190–196 | 229–238 | 1–123 | 26–35 | 50–66 | 99–112 | PYYDILTGYFAFDI (SEQ ID NO: 3026) |
| I069B12 | 1721 | 141–248 | 162–172 | 188–194 | 227–237 | 1–125 | 26–35 | 50–66 | 99–114 | MEYDILTGYYGGYFDY (SEQ ID NO: 2179) |
| I069C06 | 1722 | 143–250 | 164–174 | 190–196 | 229–239 | 1–127 | 26–35 | 50–66 | 99–116 | VLPHYDILTGYSQNWFDP (SEQ ID NO: 3000) |
| I069C09 | 1723 | 143–250 | 164–174 | 190–196 | 229–239 | 1–127 | 26–35 | 50–66 | 99–116 | VLPHYDILTGYSQNWFDP (SEQ ID NO: 3000) |
| I069D03 | 1724 | 142–249 | 163–173 | 189–195 | 228–238 | 1–126 | 26–35 | 50–66 | 99–115 | DGYYDILTGYSYYGMDV (SEQ ID NO: 2135) |
| I069E09 | 1725 | 142–249 | 163–173 | 189–195 | 228–238 | 1–126 | 26–35 | 50–66 | 99–115 | DGYYDILTGYSYYGMDV (SEQ ID NO: 2135) |
| I069E11 | 1726 | 140–247 | 161–171 | 187–193 | 226–236 | 1–124 | 26–35 | 50–66 | 99–113 | VYYDILTGYNLFFDY (SEQ ID NO: 2177) |
| I069F05 | 1727 | 141–248 | 162–172 | 188–194 | 227–237 | 1–125 | 26–35 | 50–66 | 99–114 | MEYDILTGYYGGYFDY (SEQ ID NO: 2179) |
| I069F07 | 1728 | 141–248 | 162–172 | 188–194 | 227–237 | 1–125 | 26–35 | 50–66 | 99–114 | MEYDILTGYYGGYFDY (SEQ ID NO: 2179) |
| I069F12 | 1729 | 140–247 | 161–171 | 187–193 | 226–236 | 1–124 | 26–35 | 50–66 | 99–113 | GYYDILTGYYDAFDI (SEQ ID NO: 3051) |
| I069G06 | 1730 | 142–249 | 163–173 | 189–195 | 228–238 | 1–126 | 26–35 | 50–66 | 99–115 | DGYYDILTGYSGYYMDV (SEQ ID NO: 3059) |
| I069G08 | 1731 | 145–252 | 166–176 | 192–198 | 231–241 | 1–129 | 26–35 | 50–66 | 99–118 | DRLEYYDILTGYYYYYGMDV (SEQ ID NO: 3039) |

TABLE 1-continued scFvs that Immunospecifically Bind to BLyS

| Clone ID | scFv SEQ ID NO | AAs of VL | AAs of VL CDR1 | AAs of VL CDR2 | AAs of VL CDR3 | AAs of VH | AAs of VH CDR1 | AAs of VH CDR2 | AAs of VH CDR3 | VH CDR3 Sequence (SEQ ID NO) |
|---|---|---|---|---|---|---|---|---|---|---|
| I069G11 | 1732 | 141–248 | 162–172 | 188–194 | 227–237 | 1–125 | 26–35 | 50–66 | 99–114 | MEYDILTGYYGGYFDY (SEQ ID NO: 2179) |
| I070A03 | 1733 | 141–248 | 164–174 | 190–196 | 229–237 | 1–125 | 26–35 | 50–66 | 99–114 | MEYDILTGYYGGYFDY (SEQ ID NO: 2179) |
| I070A09 | 1734 | 141–248 | 162–172 | 188–194 | 227–237 | 1–125 | 26–35 | 50–66 | 99–114 | MEYDILTGYYGGYFDY (SEQ ID NO: 2179) |
| I070B01 | 1735 | 144–254 | 166–179 | 195–201 | 234–243 | 1–128 | 26–35 | 50–66 | 99–117 | SQSDYDILTGYYYYYGMDV (SEQ ID NO: 3038) |
| I070B05 | 1736 | 141–251 | 163–176 | 192–198 | 231–240 | 1–125 | 26–35 | 50–66 | 99–114 | MEYDILTGYYGGYFDY (SEQ ID NO: 2179) |
| I070D03 | 1737 | 141–248 | 164–174 | 190–196 | 229–237 | 1–125 | 26–35 | 50–66 | 99–114 | MEYDILTGYYGGYFDY (SEQ ID NO: 2179) |
| I070D04 | 1738 | 141–251 | 163–176 | 192–198 | 231–240 | 1–125 | 26–35 | 50–66 | 99–114 | MEYDILTSYYGGYFDY (SEQ ID NO: 3034) |
| I070E01 | 1739 | 144–254 | 166–179 | 195–201 | 234–243 | 1–128 | 26–35 | 50–66 | 99–117 | SQSDYDILTGYYYYYGMDV (SEQ ID NO: 3038) |
| I070F01 | 1740 | 144–251 | 165–175 | 191–197 | 230–240 | 1–128 | 26–35 | 50–66 | 99–117 | SQSNYDILTGYYYYYGMDV (SEQ ID NO: 3067) |
| I070G10 | 1741 | 141–248 | 162–172 | 188–194 | 227–237 | 1–125 | 26–35 | 50–66 | 99–114 | MEYDILTGYYGGYFDY (SEQ ID NO: 2179) |
| I071A06 | 1742 | 135–242 | 156–166 | 182–188 | 221–231 | 1–119 | 26–35 | 50–66 | 99–108 | GMGDHYGMDV (SEQ ID NO: 2161) |
| I071B02 | 1743 | 135–245 | 157–170 | 186–192 | 225–234 | 1–119 | 26–35 | 50–66 | 99–108 | GMGDHYGMDV (SEQ ID NO: 2161) |
| I071D02 | 1744 | 137–247 | 159–172 | 188–194 | 227–236 | 1–121 | 26–35 | 50–66 | 99–110 | AGTSLMNYGTDV (SEQ ID NO: 3048) |
| I071D08 | 1745 | 146–256 | 168–181 | 197–203 | 236–245 | 1–130 | 26–37 | 52–66 | 99–119 | VPYYYDTSGGYLGEYYYGMDV (SEQ ID NO: 3010) |
| I071F01 | 1746 | 137–247 | 159–172 | 188–194 | 227–236 | 1–121 | 26–35 | 50–66 | 99–110 | AGTSLMNYGTDV (SEQ ID NO: 3048) |
| I071G09 | 1747 | 141–251 | 163–176 | 192–198 | 231–240 | 1–125 | 26–35 | 50–66 | 99–114 | ATYDPLTGYSFDGFDI (SEQ ID NO: 2153) |
| I072A01 | 1748 | 139–249 | 161–174 | 190–196 | 229–238 | 1–123 | 26–35 | 50–66 | 99–112 | SRDLLLFPHYGMDV (SEQ ID NO: 2133) |
| I072A09 | 1749 | 141–251 | 163–176 | 192–198 | 231–240 | 1–125 | 26–35 | 50–66 | 99–114 | ATYDPLTGYSFDGFDI (SEQ ID NO: 2153) |
| I072B02 | 1750 | 135–245 | 157–170 | 186–192 | 225–234 | 1–119 | 26–35 | 50–66 | 99–108 | GMGDHYGMDV (SEQ ID NO: 2161) |
| I072B10 | 1751 | 137–247 | 159–172 | 188–194 | 227–236 | 1–121 | 26–35 | 50–66 | 99–110 | AGSSLMTYGTDV (SEQ ID NO: 2773) |
| I072B11 | 1752 | 141–251 | 163–176 | 192–198 | 231–240 | 1–125 | 26–35 | 50–66 | 99–114 | ATYDPLTGYSFDGFDI (SEQ ID NO: 2153) |
| I072B12 | 1753 | 140–249 | 162–173 | 189–195 | 228–238 | 1–124 | 26–35 | 50–66 | 99–113 | ENYDYLTGYYGAFDI (SEQ ID NO: 2995) |
| I072C05 | 1754 | 135–245 | 157–169 | 185–191 | 224–234 | 1–119 | 26–35 | 50–66 | 99–108 | GMGDHYGMDV (SEQ ID NO: 2161) |
| I072C10 | 1755 | 141–248 | 162–172 | 188–194 | 227–237 | 1–125 | 26–35 | 50–66 | 99–114 | ATYDPLTGYSFDGFDI (SEQ ID NO: 2153) |
| I072D01 | 1756 | 141–251 | 163–176 | 192–198 | 231–240 | 1–125 | 26–35 | 50–66 | 99–114 | ATYDPLTGYSFDGFDI (SEQ ID NO: 2153) |
| I072D05 | 1757 | 135–245 | 157–169 | 185–191 | 224–234 | 1–119 | 26–35 | 50–66 | 99–108 | GMGDHYGMDV (SEQ ID NO: 2161) |
| I072E01 | 1758 | 141–251 | 163–176 | 192–198 | 231–240 | 1–125 | 26–35 | 50–66 | 99–114 | ATYDPLTGYSFDGFDI (SEQ ID NO: 2153) |
| I072E04 | 1759 | 144–254 | 166–179 | 195–201 | 234–243 | 1–128 | 26–35 | 50–66 | 99–117 | EGSYDILTGYYVGVGRMDV (SEQ ID NO: 2171) |
| I072E05 | 1760 | 141–251 | 163–176 | 192–198 | 231–240 | 1–125 | 26–35 | 50–66 | 99–114 | ATYDPLTGYSFDGFDI (SEQ ID NO: 2153) |
| I072E06 | 1761 | 135–242 | 156–166 | 182–188 | 221–231 | 1–119 | 26–35 | 50–66 | 99–108 | GMGDHYGMDV (SEQ ID NO: 2161) |
| I072F03 | 1762 | 135–242 | 156–166 | 182–188 | 221–231 | 1–119 | 26–35 | 50–66 | 99–108 | GMGDHYGMDV (SEQ ID NO: 2161) |
| I072F07 | 1763 | 141–251 | 163–176 | 192–198 | 231–240 | 1–125 | 26–35 | 50–66 | 99–114 | ATYDPLTGYSFDGFDI (SEQ ID NO: 2153) |
| I072F11 | 1764 | 140–247 | 161–171 | 187–193 | 226–236 | 1–124 | 26–35 | 50–66 | 99–113 | DEYDILTGLLQGMDV (SEQ ID NO: 2883) |
| I072G03 | 1765 | 141–248 | 162–172 | 188–194 | 227–237 | 1–125 | 26–35 | 50–66 | 99–114 | ATYDPLTGYSFDGFDI (SEQ ID NO: 2153) |
| I072G04 | 1766 | 137–247 | 159–171 | 187–193 | 226–236 | 1–121 | 26–35 | 50–68 | 101–110 | RDILTGFYDS (SEQ ID NO: 2933) |
| I072G05 | 1767 | 137–247 | 159–171 | 187–193 | 226–236 | 1–121 | 26–35 | 50–66 | 99–110 | GYRNDWYGAFEI (SEQ ID NO: 3079) |
| I072G09 | 1768 | 141–251 | 163–176 | 192–198 | 231–240 | 1–125 | 26–35 | 50–66 | 99–114 | ATYDPLTGYSFDGFDI (SEQ ID NO: 2153) |
| I072H03 | 1769 | 141–251 | 163–176 | 192–198 | 231–240 | 1–125 | 26–35 | 50–66 | 99–114 | ATYDPLTGYSFDGFDI (SEQ ID NO: 2153) |
| I072H07 | 1770 | 137–247 | 159–172 | 188–194 | 227–236 | 1–121 | 26–35 | 50–66 | 99–110 | AGTSLMNYGMDV (SEQ ID NO: 3070) |
| I073A02 | 1771 | 141–248 | 164–174 | 190–196 | 229–237 | 1–125 | 26–35 | 50–66 | 99–114 | GPYDILTGYYRDAFDI (SEQ ID NO: 2998) |
| I073A03 | 1772 | 142–252 | 164–177 | 193–199 | 232–241 | 1–126 | 26–35 | 50–66 | 99–115 | THYDILTGYYTADAFDI (SEQ ID NO: 3019) |
| I073A04 | 1773 | 148–258 | 170–183 | 199–205 | 238–247 | 1–132 | 26–35 | 50–66 | 99–121 | VQMDSEYYDLLTGINVGPYYFDY (SEQ ID NO: 2132) |
| I073A05 | 1774 | 141–251 | 163–176 | 192–198 | 231–240 | 1–125 | 26–35 | 50–66 | 99–114 | ATYDPLTGYSFDGFDI (SEQ ID NO: 2153) |
| I073A06 | 1775 | 141–251 | 163–176 | 192–198 | 231–240 | 1–125 | 26–35 | 50–66 | 99–114 | ATYDPLTGYSFDGFDI (SEQ ID NO: 2153) |
| I073A09 | 1776 | 141–251 | 163–176 | 192–198 | 231–240 | 1–125 | 26–35 | 50–66 | 99–114 | ATYDPLTGYSFDGFDI (SEQ ID NO: 2153) |
| I073A10 | 1777 | 146–253 | 167–177 | 193–199 | 232–242 | 1–130 | 26–35 | 50–66 | 99–119 | GDFGDYDILTGYYPVYYGMDV (SEQ ID NO: 3082) |

TABLE 1-continued scFvs that Immunospecifically Bind to BLyS

| Clone ID | scFv SEQ ID NO | AAs of VL | AAs of VL CDR1 | AAs of VL CDR2 | AAs of VL CDR3 | AAs of VH | AAs of VH CDR1 | AAs of VH CDR2 | AAs of VH CDR3 | VH CDR3 Sequence (SEQ ID NO) |
|---|---|---|---|---|---|---|---|---|---|---|
| I073A11 | 1778 | 141–248 | 164–174 | 190–196 | 229–237 | 1–125 | 26–35 | 50–66 | 99–114 | SYYDILTGYYPFGMDV (SEQ ID NO: 3004) |
| I073B02 | 1779 | 144–254 | 166–179 | 195–201 | 234–243 | 1–128 | 26–35 | 50–66 | 99–117 | DLWYYDILTGYYLDDAFDI (SEQ ID NO: 2999) |
| I073B05 | 1780 | 144–254 | 166–179 | 195–201 | 234–243 | 1–128 | 26–35 | 50–66 | 99–117 | DLWYYDILTGYYLDDAFDI (SEQ ID NO: 2999) |
| I073B06 | 1781 | 139–246 | 160–170 | 186–192 | 225–235 | 1–123 | 26–35 | 50–66 | 99–112 | SRDLLLFPHYGMDV (SEQ ID NO: 2133) |
| I073B07 | 1782 | 138–248 | 160–173 | 189–195 | 228–237 | 1–122 | 26–35 | 50–66 | 99–111 | TRMDVLTRYYSDF (SEQ ID NO: 2750) |
| I073B08 | 1783 | 141–251 | 163–176 | 192–198 | 231–240 | 1–125 | 26–35 | 50–66 | 99–114 | ATYDPLTGYSFDGFDI (SEQ ID NO: 2153) |
| I073B11 | 1784 | 141–251 | 163–176 | 192–198 | 231–240 | 1–125 | 26–35 | 50–66 | 99–114 | ATYDPLTGYSFDGFDI (SEQ ID NO: 2153) |
| I073C01 | 1785 | 141–248 | 162–172 | 188–194 | 227–237 | 1–125 | 26–35 | 50–66 | 99–114 | GYHDTLTSYNYNWFDP (SEQ ID NO: 3006) |
| I073C02 | 1786 | 148–255 | 169–179 | 195–201 | 234–244 | 1–132 | 26–35 | 50–66 | 99–121 | AQMDSEYYDLLTGINVGPYYFDY (SEQ ID NO: 3076) |
| I073C04 | 1787 | 141–252 | 164–177 | 193–199 | 232–241 | 1–125 | 26–35 | 50–66 | 99–114 | ATYDPLTGYSFDGFDI (SEQ ID NO: 2153) |
| I073G07 | 1788 | 134–241 | 155–165 | 181–187 | 220–230 | 1–118 | 26–35 | 50–66 | 99–107 | GMGDHYMDV (SEQ ID NO: 3008) |
| I073G08 | 1789 | 142–252 | 164–177 | 193–199 | 232–241 | 1–126 | 26–35 | 50–66 | 99–115 | EMGYDILTGYYLNYMDV (SEQ ID NO: 2862) |
| I073C09 | 1790 | 141–248 | 162–172 | 188–194 | 227–237 | 1–125 | 26–35 | 50–66 | 99–114 | QHYDILTGYSQEPFDI (SEQ ID NO: 3022) |
| I073C11 | 1791 | 146–256 | 168–181 | 197–203 | 236–245 | 1–130 | 26–35 | 50–68 | 101–119 | FNPTYDILTGYYIGGYFQH (SEQ ID NO: 2155) |
| I073C12 | 1792 | 141–251 | 163–176 | 192–198 | 231–240 | 1–125 | 26–35 | 50–66 | 99–114 | ATYDPLTGYSFDGFDI (SEQ ID NO: 2153) |
| I073D01 | 1793 | 141–251 | 163–176 | 192–198 | 231–240 | 1–125 | 26–35 | 50–66 | 99–114 | ATYDPLTGYSFDGFDI (SEQ ID NO: 2153) |
| I073D03 | 1794 | 135–245 | 157–169 | 185–191 | 224–234 | 1–119 | 26–35 | 50–66 | 99–108 | GMGDHYGMDV (SEQ ID NO: 2161) |
| I073D06 | 1795 | 141–251 | 163–176 | 192–198 | 231–240 | 1–125 | 26–35 | 50–66 | 99–114 | ATYDPLTGYSFDGFDI (SEQ ID NO: 2153) |
| I073D08 | 1796 | 144–254 | 166–179 | 195–201 | 234–243 | 1–128 | 26–35 | 50–66 | 99–117 | EVRNYDLLTRSYLAGPLDN (SEQ ID NO: 2751) |
| I073D10 | 1797 | 140–250 | 162–175 | 191–197 | 230–239 | 1–124 | 26–35 | 50–68 | 101–113 | QYYDILTGYELDI (SEQ ID NO: 3073) |
| I073D11 | 1798 | 141–251 | 163–176 | 192–198 | 231–240 | 1–125 | 26–35 | 50–66 | 99–114 | ATYDPLTGYSFDGFDI (SEQ ID NO: 2153) |
| I073E01 | 1799 | 148–258 | 170–183 | 199–205 | 238–247 | 1–132 | 26–37 | 52–69 | 102–121 | EGAHYDILTGHNYYHYGMDV (SEQ ID NO: 2747) |
| I073E02 | 1800 | 141–251 | 163–176 | 192–198 | 231–240 | 1–125 | 26–35 | 50–66 | 99–114 | ATYDPLTGYSFDGFDI (SEQ ID NO: 2153) |
| I073E03 | 1801 | 141–251 | 163–176 | 192–198 | 231–240 | 1–125 | 26–35 | 50–66 | 99–114 | ATYDPLTGYSLDGFDI (SEQ ID NO: 3003) |
| I073E05 | 1802 | 141–251 | 163–176 | 192–198 | 231–240 | 1–125 | 26–35 | 50–66 | 99–114 | QHYDILTGYSQEPFDI (SEQ ID NO: 3022) |
| I073E06 | 1803 | 141–251 | 163–176 | 192–198 | 231–240 | 1–125 | 26–35 | 50–66 | 99–114 | ATYDPLTGYSFDGFDI (SEQ ID NO: 2153) |
| I073E08 | 1804 | 140–250 | 162–175 | 191–197 | 230–239 | 1–124 | 26–35 | 50–66 | 99–113 | ENYDFLTGYYGAFDI (SEQ ID NO: 2772) |
| I073F01 | 1805 | 141–251 | 163–175 | 191–197 | 230–240 | 1–125 | 26–35 | 50–66 | 99–114 | ATYDPLTGYSFDGFDI (SEQ ID NO: 2153) |
| I073F02 | 1806 | 141–251 | 163–175 | 191–197 | 230–240 | 1–125 | 26–35 | 50–66 | 99–114 | ATYDPLTGYSFDGFDI (SEQ ID NO: 2153) |
| I073F03 | 1807 | 141–251 | 163–176 | 192–198 | 231–240 | 1–125 | 26–35 | 50–66 | 99–114 | ATYDPLTGYSFDGFDI (SEQ ID NO: 2153) |
| I073F05 | 1808 | 141–251 | 163–176 | 192–198 | 231–240 | 1–125 | 26–35 | 50–66 | 99–114 | ATYDPLTGYSFDGFDI (SEQ ID NO: 2153) |
| I073F07 | 1809 | 141–251 | 163–175 | 191–197 | 230–240 | 1–125 | 26–35 | 50–66 | 99–114 | GEYDILTGYPYWYFDL (SEQ ID NO: 3023) |
| I073F09 | 1810 | 141–251 | 163–176 | 192–198 | 231–240 | 1–125 | 26–35 | 50–66 | 99–114 | ATYDPLTGYSFDGFDT (SEQ ID NO: 2153) |
| I073F11 | 1811 | 141–251 | 163–176 | 192–198 | 231–240 | 1–125 | 26–35 | 50–66 | 99–114 | ATYDPLTGYSFDGFDI (SEQ ID NO: 2153) |
| I073F12 | 1812 | 141–251 | 163–175 | 191–197 | 230–240 | 1–125 | 26–35 | 50–66 | 99–114 | ATYDPLTGYSFDGFDI (SEQ ID NO: 2153) |
| I073G03 | 1813 | 143–253 | 165–178 | 194–200 | 233–242 | 1–127 | 26–35 | 50–66 | 99–116 | DGSYDILTGYYIDNYMDV (SEQ ID NO: 2154) |
| I073G04 | 1814 | 143–253 | 165–178 | 194–200 | 233–242 | 1–127 | 26–35 | 50–65 | 98–116 | GEGGYDILTGYLRGYGMDV (SEQ ID NO: 3037) |
| I073G05 | 1815 | 135–245 | 157–169 | 185–191 | 224–234 | 1–119 | 26–35 | 50–66 | 99–108 | GMGDHYGMDV (SEQ ID NO: 2161) |
| I073G06 | 1816 | 141–248 | 162–172 | 188–194 | 227–237 | 1–125 | 26–35 | 50–66 | 99–114 | ATYDPLTGYSFDGFDI (SEQ ID NO: 2153) |
| I073G07 | 1817 | 142–249 | 163–173 | 189–195 | 228–238 | 1–126 | 26–35 | 50–66 | 99–115 | GSYYDILTGISSLGMDV (SEQ ID NO: 3063) |
| I073G08 | 1818 | 139–246 | 160–170 | 186–192 | 225–235 | 1–123 | 26–35 | 50–66 | 99–112 | SRDLLLFPHYGMDV (SEQ ID NO: 2133) |
| I073G09 | 1819 | 145–255 | 167–180 | 196–202 | 235–244 | 1–129 | 26–35 | 50–66 | 99–118 | DRGHYDILTGYYIEPSGFDY (SEQ ID NO: 3061) |
| I073G10 | 1820 | 135–245 | 157–170 | 186–192 | 225–234 | 1–119 | 26–35 | 50–66 | 99–108 | GPGVIGNYDY (SEQ ID NO: 2749) |
| I073G12 | 1821 | 142–252 | 164–177 | 193–199 | 232–241 | 1–126 | 26–35 | 50–68 | 101–115 | GGMIRAREDYYYMDV (SEQ ID NO: 3083) |
| I073H01 | 1822 | 141–251 | 163–176 | 192–198 | 231–240 | 1–125 | 26–35 | 50–66 | 99–114 | ATYDPLTGYSFDGFDI (SEQ ID NO: 2153) |
| I073H03 | 1823 | 141–248 | 162–172 | 188–194 | 227–237 | 1–125 | 26–35 | 50–66 | 99–114 | ATYDPLTGYSFDGFDI (SEQ ID NO: 2153) |

TABLE 1-continued scFvs that Immunospecifically Bind to BLyS

| Clone ID | scFv SEQ ID NO | AAs of VL | AAs of VL CDR1 | AAs of VL CDR2 | AAs of VL CDR3 | AAs of VH | AAs of VH CDR1 | AAs of VH CDR2 | AAs of VH CDR3 | VH CDR3 Sequence (SEQ ID NO) |
|---|---|---|---|---|---|---|---|---|---|---|
| I073H05 | 1824 | 141–251 | 163–176 | 192–198 | 231–240 | 1–125 | 26–35 | 50–66 | 99–114 | ATYDPLTGYSFDGFDI (SEQ ID NO: 2153) |
| I073H06 | 1825 | 141–251 | 163–176 | 192–198 | 231–240 | 1–125 | 26–35 | 50–66 | 99–114 | ATYDPLTGYSFDGFDI (SEQ ID NO: 2153) |
| I073H07 | 1826 | 138–245 | 159–169 | 185–191 | 224–234 | 1–122 | 26–35 | 50–66 | 99–111 | TYYDILTGYYFDY (SEQ ID NO: 3056) |
| I073H08 | 1827 | 141–251 | 163–176 | 192–198 | 231–240 | 1–125 | 26–35 | 50–66 | 99–114 | ATYDPLTGYSFDGFDI (SEQ ID NO: 2153) |
| I074A05 | 1828 | 143–255 | 166–179 | 195–201 | 234–244 | 1–127 | 26–35 | 50–66 | 99–116 | LPPYDMLTGYYVGGGMDV (SEQ ID NO: 3050) |
| I074A06 | 1829 | 143–253 | 167–177 | 193–199 | 232–242 | 1–127 | 26–35 | 50–66 | 99–116 | AKPYTDFSRGSDADAFDV (SEQ ID NO: 3065) |
| I074B03 | 1830 | 133–242 | 156–166 | 182–188 | 221–231 | 1–117 | 26–35 | 50–66 | 99–106 | DQGRYLDL (SEQ ID NO: 2175) |
| I074B11 | 1831 | 139–251 | 162–175 | 191–197 | 230–240 | 1–123 | 26–35 | 50–66 | 99–112 | RYGDPFYYYYYMNV (SEQ ID NO: 2755) |
| I074C07 | 1832 | 140–251 | 163–175 | 191–197 | 230–240 | 1–124 | 26–34 | 49–65 | 98–113 | ELGLSIVGATTGALDM (SEQ ID NO: 2174) |
| I074D03 | 1833 | 141–251 | 165–175 | 191–197 | 230–240 | 1–125 | 26–35 | 50–66 | 99–114 | GGYDILTQYPAEFFHP (SEQ ID NO: 2764) |
| I074D04 | 1834 | 133–246 | 156–169 | 185–191 | 224–235 | 1–117 | 26–35 | 50–66 | 99–106 | DQGRYLDL (SEQ ID NO: 2175) |
| I074D05 | 1835 | 143–253 | 167–177 | 193–199 | 232–242 | 1–127 | 26–35 | 50–66 | 99–116 | DRYYDILTKGDYYYGMDV (SEQ ID NO: 3060) |
| I074D07 | 1836 | 150–262 | 173–186 | 202–208 | 241–251 | 1–134 | 26–35 | 50–66 | 99–123 | VQGETYYDILTGYWGPKRDLYGMDV (SEQ ID NO: 3069) |
| I074D08 | 1837 | 140–251 | 163–175 | 191–197 | 230–240 | 1–124 | 26–34 | 49–65 | 98–113 | ELGLSIVVATTGALDM (SEQ ID NO: 2980) |
| I074D11 | 1838 | 138–249 | 161–174 | 190–196 | 229–238 | 1–122 | 26–35 | 50–66 | 99–111 | ESEGGDYTNPFGY (SEQ ID NO: 2991) |
| I074E05 | 1839 | 133–245 | 156–169 | 185–191 | 224–234 | 1–117 | 26–35 | 50–66 | 99–106 | DQGRYLDL (SEQ ID NO: 2175) |
| I074E07 | 1840 | 140–251 | 163–175 | 191–197 | 230–240 | 1–124 | 26–34 | 49–65 | 98–113 | ELGLSIVGATTGALDM (SEQ ID NO: 2174) |
| I074E09 | 1841 | 146–258 | 169–182 | 198–204 | 237–247 | 1–130 | 26–35 | 50–68 | 101–119 | DPGNYDILTGYYYYYGMDV (SEQ ID NO: 2935) |
| I074E11 | 1842 | 137–244 | 160–170 | 186–192 | 225–233 | 1–121 | 26–35 | 50–66 | 99–110 | VRLPHHHYFMAV (SEQ ID NO: 3075) |
| I074H05 | 1843 | 142–254 | 166–178 | 194–200 | 233–243 | 1–126 | 26–35 | 50–66 | 99–115 | ESSITVNPPYYFYGMDV (SEQ ID NO: 3025) |
| I075A03 | 1844 | 133–242 | 158–168 | 184–190 | 223–231 | 1–117 | 26–35 | 50–66 | 99–106 | DQGRYLDL (SEQ ID NO: 2175) |
| I075A10 | 1845 | 133–244 | 157–169 | 185–191 | 224–233 | 1–117 | 26–35 | 50–66 | 99–106 | DQGRYLDL (SEQ ID NO: 2175) |
| I075B07 | 1846 | 143–254 | 166–178 | 194–200 | 233–243 | 1–127 | 26–35 | 50–66 | 99–116 | SPEGDYQPLSSNYNWLDP (SEQ ID NO: 3011) |
| I075D11 | 1847 | 133–246 | 156–169 | 185–191 | 224–235 | 1–117 | 26–36 | 51–66 | 99–106 | GKEGYNDN (SEQ ID NO: 3089) |
| I075D12 | 1848 | 143–253 | 167–177 | 193–199 | 232–242 | 1–127 | 26–35 | 50–66 | 99–116 | GSGYDLLTGYFTGSPLDY (SEQ ID NO: 2766) |
| I075G02 | 1849 | 143–255 | 166–179 | 195–201 | 234–244 | 1–127 | 26–35 | 50–66 | 99–116 | SPEGDYQPLSSNYNWLDP (SEQ ID NO: 3011) |
| I075G09 | 1850 | 142–253 | 165–177 | 193–199 | 232–242 | 1–126 | 26–35 | 50–66 | 99–115 | MGHYDILTGYRHYGMDV (SEQ ID NO: 2831) |
| I075G10 | 1851 | 138–250 | 162–174 | 190–196 | 229–239 | 1–122 | 26–35 | 50–66 | 99–111 | GNYDILTGYPHDL (SEQ ID NO: 3086) |
| I075H05 | 1852 | 141–252 | 164–176 | 192–198 | 231–241 | 1–125 | 26–35 | 50–66 | 99–114 | SYYDILTGYYHTPLDY (SEQ ID NO: 2853) |
| I075H07 | 1853 | 143–253 | 167–177 | 193–199 | 232–242 | 1–127 | 26–35 | 50–66 | 99–116 | GSGYDLLTGYFTGSPLDY (SEQ ID NO: 2766) |
| I076A11 | 1854 | 141–254 | 164–177 | 193–199 | 232–243 | 1–125 | 26–35 | 50–66 | 99–114 | DDRDILTNYYLEYFQH (SEQ ID NO: 2868) |
| I076A12 | 1855 | 143–256 | 166–178 | 194–200 | 233–245 | 1–127 | 26–35 | 50–66 | 99–116 | GSGYDVLTGYFTGSPLDY (SEQ ID NO: 3057) |
| I076B06 | 1856 | 140–249 | 164–174 | 190–196 | 229–238 | 1–124 | 26–35 | 50–66 | 99–113 | GRYDILTGYFTSFDY (SEQ ID NO: 3066) |
| I076B10 | 1857 | 141–254 | 164–177 | 193–199 | 232–243 | 1–125 | 26–35 | 50–66 | 99–114 | DDRDILTNYYLEYFQH (SEQ ID NO: 2868) |
| I076B12 | 1858 | 143–253 | 167–177 | 193–199 | 232–242 | 1–127 | 26–35 | 50–66 | 99–116 | GTGYDILTGYYMGSAFDQ (SEQ ID NO: 2800) |
| I076C06 | 1859 | 142–253 | 165–177 | 193–199 | 232–242 | 1–126 | 26–35 | 50–66 | 99–115 | MGHYDILTGYRHYGMDV (SEQ ID NO: 2831) |
| I076C11 | 1860 | 133–245 | 156–168 | 184–190 | 223–234 | 1–117 | 26–35 | 50–66 | 99–106 | DQGRYLDL (SEQ ID NO: 2175) |
| I076D06 | 1861 | 140–252 | 163–176 | 192–198 | 231–241 | 1–124 | 26–34 | 49–65 | 98–113 | ELGLSIVGATTGALDM (SEQ ID NO: 2174) |
| I076E05 | 1862 | 143–255 | 166–179 | 195–201 | 234–244 | 1–127 | 26–35 | 50–66 | 99–116 | GTGYDILTGYYMGSAFDQ (SEQ ID NO: 2800) |
| I076E08 | 1863 | 133–243 | 157–167 | 183–189 | 222–232 | 1–117 | 26–35 | 50–66 | 99–106 | DQGRYLDL (SEQ ID NO: 2175) |
| I076F06 | 1864 | 133–245 | 156–169 | 185–191 | 224–234 | 1–117 | 26–36 | 51–66 | 99–106 | RDVQGAPY (SEQ ID NO: 3088) |
| I076G01 | 1865 | 143–254 | 166–178 | 194–200 | 233–243 | 1–127 | 26–35 | 50–66 | 99–116 | VEGVYDILTGYSFDAFDI (SEQ ID NO: 3078) |
| I076H01 | 1866 | 144–254 | 168–178 | 194–200 | 233–243 | 1–128 | 26–35 | 50–66 | 99–117 | EQGYDILTGYYPEGGWFDP (SEQ ID NO: 2834) |
| I076H03 | 1867 | 140–250 | 164–174 | 190–196 | 229–239 | 1–124 | 26–34 | 49–65 | 98–113 | ELGLSIVGATTGALDM (SEQ ID NO: 2174) |
| I077B05 | 1868 | 147–257 | 169–182 | 198–204 | 237–246 | 1–131 | 26–37 | 52–69 | 102–120 | DKSYYDILTGYYYYYGMDV (SEQ ID NO: 3052) |

TABLE 1-continued scFvs that Immunospecifically Bind to BLyS

| Clone ID | scFv SEQ ID NO | AAs of VL | AAs of VL CDR1 | AAs of VL CDR2 | AAs of VL CDR3 | AAs of VH | AAs of VH CDR1 | AAs of VH CDR2 | AAs of VH CDR3 | VH CDR3 Sequence (SEQ ID NO) |
|---|---|---|---|---|---|---|---|---|---|---|
| I077C10 | 1869 | 141–251 | 163–176 | 192–198 | 231–240 | 1–125 | 26–35 | 50–66 | 99–114 | MEYDILTGYYGGYFDY (SEQ ID NO: 2179) |
| I077D01 | 1870 | 141–251 | 163–176 | 192–198 | 231–240 | 1–125 | 26–35 | 50–66 | 99–114 | MEYDILTGYYGGYFDY (SEQ ID NO: 2179) |
| I077D04 | 1871 | 141–248 | 162–172 | 188–194 | 227–237 | 1–125 | 26–35 | 50–66 | 99–114 | MEYDILTGYYGGYFDY (SEQ ID NO: 2179) |
| I077D11 | 1872 | 141–251 | 163–176 | 192–198 | 231–240 | 1–125 | 26–35 | 50–66 | 99–114 | MEYDILTGYYGGYFDY (SEQ ID NO: 2179) |
| I077D12 | 1873 | 140–247 | 161–171 | 187–193 | 226–236 | 1–124 | 26–35 | 50–66 | 99–113 | EKYDILTGYYDAFDI (SEQ ID NO: 3046) |
| I077E01 | 1874 | 142–252 | 164–177 | 193–199 | 232–241 | 1–126 | 26–35 | 50–66 | 99–115 | EMGYDILTGYYLNYMDV (SEQ ID NO: 2862) |
| I077E03 | 1875 | 142–252 | 164–177 | 193–199 | 232–241 | 1–126 | 26–35 | 50–66 | 99–115 | EMGYDILTGYYLNYMDV (SEQ ID NO: 2862) |
| I077E08 | 1876 | 141–248 | 164–174 | 190–196 | 229–237 | 1–125 | 26–35 | 50–66 | 99–114 | MEYDILTGYYGGYFDY (SEQ ID NO: 2179) |
| I077F05 | 1877 | 141–248 | 162–172 | 188–194 | 227–237 | 1–125 | 26–35 | 50–66 | 99–114 | MEYDILTGYYGGYFDY (SEQ ID NO: 2179) |
| I077G06 | 1878 | 141–251 | 163–176 | 192–198 | 231–240 | 1–125 | 26–35 | 50–66 | 99–114 | MEYDILTGYYGGYFDY (SEQ ID NO: 2179) |
| I077H02 | 1879 | 141–248 | 164–174 | 190–196 | 229–237 | 1–125 | 26–35 | 50–66 | 99–114 | MEYDILTGYYGGYFDY (SEQ ID NO: 2179) |
| I078B05 | 1880 | 143–253 | 165–178 | 194–200 | 233–242 | 1–127 | 26–35 | 50–66 | 99–116 | ESHYDILTGYYSNPSFDI (SEQ ID NO: 2994) |
| I079E02 | 1881 | 137–244 | 160–170 | 186–192 | 225–233 | 1–121 | 26–35 | 50–66 | 99–110 | DSGSYYYDAFDI (SEQ ID NO: 2194) |
| I079F11 | 1882 | 132–239 | 155–165 | 181–187 | 220–228 | 1–116 | 26–35 | 50–66 | 99–105 | TGSGFDY (SEQ ID NO: 2192) |
| I082G02 | 1883 | 136–243 | 159–169 | 185–191 | 224–232 | 1–120 | 26–35 | 50–66 | 99–109 | DGYRTNDALDI (SEQ ID NO: 2191) |
| I082H08 | 1884 | 131–242 | 154–167 | 183–189 | 222–231 | 1–115 | 26–35 | 50–66 | 99–104 | DWDMDV (SEQ ID NO: 2193) |
| I099D03 | 1885 | 136–247 | 159–172 | 188–194 | 227–236 | 1–120 | 26–35 | 50–66 | 99–109 | DNGGGTIGFDY (SEQ ID NO: 2195) |
| I079B05 | 1886 | 130–240 | 152–165 | 181–187 | 220–229 | 1–114 | 26–35 | 50–66 | 99–103 | FVLDY (SEQ ID NO: 2210) |
| I079B12 | 1887 | 134–241 | 157–167 | 183–189 | 222–230 | 1–118 | 26–35 | 50–66 | 99–107 | WTSSGAFDI (SEQ ID NO: 2205) |
| I079C01 | 1888 | 131–241 | 153–166 | 182–188 | 221–230 | 1–115 | 26–35 | 50–66 | 99–104 | DWDMDV (SEQ ID NO: 2193) |
| I079F06 | 1889 | 134–241 | 157–167 | 183–189 | 222–230 | 1–118 | 26–35 | 50–66 | 99–107 | DNLHAAFDI (SEQ ID NO: 2202) |
| I079F08 | 1890 | 138–248 | 160–172 | 188–194 | 227–237 | 1–122 | 26–35 | 50–66 | 99–111 | YYYHSSGSDAFDI (SEQ ID NO: 2206) |
| I080A03 | 1891 | 138–249 | 161–173 | 189–195 | 228–238 | 1–122 | 26–35 | 50–66 | 99–111 | VGIKAAAVDNFEY (SEQ ID NO: 2197) |
| I080A08 | 1892 | 135–247 | 158–171 | 187–193 | 226–236 | 1–119 | 26–35 | 50–66 | 99–108 | VHSTGYAFEN (SEQ ID NO: 2200) |
| I080B01 | 1893 | 142–254 | 166–178 | 194–200 | 233–243 | 1–126 | 26–35 | 50–66 | 99–115 | EYSGYHYVEGGSYAMDV (SEQ ID NO: 2201) |
| I080D03 | 1894 | 138–249 | 161–173 | 189–195 | 228–238 | 1–122 | 26–35 | 50–66 | 99–111 | VGIKAAAVDNFEY (SEQ ID NO: 2197) |
| I080E05 | 1895 | 141–253 | 164–177 | 193–199 | 232–242 | 1–125 | 26–35 | 50–66 | 99–114 | EGGGDAYDVAPYYFDY (SEQ ID NO: 2204) |
| I080G07 | 1896 | 136–245 | 161–172 | 188–194 | 227–234 | 1–120 | 26–35 | 50–66 | 99–109 | EGPGYYYGMDV (SEQ ID NO: 2209) |
| I080G09 | 1897 | 136–249 | 159–172 | 188–194 | 227–238 | 1–120 | 26–35 | 50–66 | 99–109 | DNGGGTIGFDY (SEQ ID NO: 2195) |
| I082A05 | 1898 | 131–240 | 153–165 | 181–187 | 220–229 | 1–115 | 26–35 | 50–66 | 99–104 | DLDFDY (SEQ ID NO: 2208) |
| I082B08 | 1899 | 137–247 | 159–171 | 187–193 | 226–236 | 1–121 | 26–35 | 50–66 | 99–110 | DLGIAGTIYFDY (SEQ ID NO: 2207) |
| I082C03 | 1900 | 138–245 | 161–171 | 187–193 | 226–234 | 1–122 | 26–35 | 50–66 | 99–111 | DASRDIVVLPLAI (SEQ ID NO: 2198) |
| I082D07 | 1901 | 134–241 | 157–167 | 183–189 | 222–230 | 1–118 | 26–35 | 50–66 | 99–107 | WTSSGAFDI (SEQ ID NO: 2205) |
| I082G01 | 1902 | 138–245 | 161–171 | 187–193 | 226–234 | 1–122 | 26–35 | 50–66 | 99–111 | DRGSGWPNWYFDL (SEQ ID NO: 2212) |
| I083B12 | 1903 | 137–247 | 161–171 | 187–193 | 226–236 | 1–121 | 26–35 | 50–66 | 99–110 | ESGAGGYYYDDY (SEQ ID NO: 2196) |
| I083G03 | 1904 | 138–249 | 161–173 | 189–195 | 228–238 | 1–122 | 26–35 | 50–66 | 99–111 | VGIKAAAVDNFEY (SEQ ID NO: 2197) |
| I084A01 | 1905 | 130–240 | 152–164 | 180–186 | 219–229 | 1–114 | 26–35 | 50–66 | 99–103 | DTTDY (SEQ ID NO: 2203) |
| I084B02 | 1906 | 130–237 | 153–163 | 179–185 | 218–226 | 1–114 | 26–35 | 50–66 | 99–103 | DTTDY (SEQ ID NO: 2203) |
| I084C04 | 1907 | 131–238 | 152–162 | 178–184 | 217–227 | 1–115 | 25–34 | 49–65 | 98–104 | NLWGLDY (SEQ ID NO: 2199) |
| I084C11 | 1908 | 134–244 | 156–169 | 185–191 | 224–233 | 1–118 | 26–35 | 50–66 | 99–107 | GNAWGAFDI (SEQ ID NO: 2211) |
| I079A01 | 1909 | 134–243 | 156–168 | 184–190 | 223–232 | 1–118 | 26–35 | 50–66 | 99–107 | EGVAAGEDY (SEQ ID NO: 3123) |
| I079A03 | 1910 | 134–244 | 156–169 | 185–191 | 224–233 | 1–118 | 26–35 | 50–66 | 99–107 | GGMDWDFDY (SEQ ID NO: 3183) |
| I079A04 | 1911 | 134–241 | 155–165 | 181–187 | 220–230 | 1–118 | 26–35 | 50–66 | 99–107 | VDSSGYAYY (SEQ ID NO: 3213) |
| I079A06 | 1912 | 133–240 | 154–164 | 180–186 | 219–229 | 1–117 | 26–35 | 50–66 | 99–106 | DAAVTAEG (SEQ ID NO: 3142) |
| I079A07 | 1913 | 136–246 | 158–170 | 186–192 | 225–235 | 1–120 | 26–35 | 50–66 | 99–109 | GSNYSPDAFDI (SEQ ID NO: 3112) |
| I079A10 | 1914 | 148–255 | 169–179 | 195–201 | 234–244 | 1–132 | 26–35 | 50–68 | 101–121 | LPPDLRYCDGGICPGFDWLGP (SEQ ID NO: 3163) |

TABLE 1-continued scFvs that Immunospecifically Bind to BLyS

| Clone ID | scFv SEQ ID NO | AAs of VL | AAs of VL CDR1 | AAs of VL CDR2 | AAs of VL CDR3 | AAs of VH | AAs of VH CDR1 | AAs of VH CDR2 | AAs of VH CDR3 | VH CDR3 Sequence (SEQ ID NO) |
|---|---|---|---|---|---|---|---|---|---|---|
| I079A11 | 1915 | 135–242 | 158–168 | 184–190 | 223–231 | 1–119 | 26–35 | 50–66 | 99–108 | GPSYYYYMAV (SEQ ID NO: 3114) |
| I079B02 | 1916 | 134–243 | 156–168 | 184–190 | 223–232 | 1–118 | 26–35 | 50–66 | 99–107 | EGVAAGEDY (SEQ ID NO: 3123) |
| I079B03 | 1917 | 136–246 | 158–170 | 186–192 | 225–235 | 1–120 | 26–35 | 50–66 | 99–109 | GSNYSPDAFDI (SEQ ID NO: 3112) |
| I079B04 | 1918 | 130–240 | 152–165 | 181–187 | 220–229 | 1–114 | 26–35 | 50–66 | 99–103 | LLSDY (SEQ ID NO: 3168) |
| I079B07 | 1919 | 138–245 | 159–169 | 185–191 | 224–234 | 1–122 | 26–35 | 50–66 | 99–111 | DLSGSYFSRYFDY (SEQ ID NO: 3193) |
| I079B09 | 1920 | 139–246 | 162–172 | 188–194 | 227–235 | 1–123 | 26–35 | 50–66 | 99–112 | VEWEDIVVGSAFDI (SEQ ID NO: 3128) |
| I079C02 | 1921 | 144–251 | 167–177 | 193–199 | 232–240 | 1–128 | 26–35 | 50–66 | 99–117 | VTSLYSSSSGGYYYYGMDV (SEQ ID NO: 3145) |
| I079C04 | 1922 | 132–239 | 155–165 | 181–187 | 220–228 | 1–116 | 26–35 | 50–66 | 99–105 | GWRGVDY (SEQ ID NO: 3195) |
| I079C05 | 1923 | 140–247 | 163–173 | 189–195 | 228–236 | 1–124 | 26–35 | 50–66 | 99–113 | AGGNPRSGSLVYFDY (SEQ ID NO: 3225) |
| I079C07 | 1924 | 137–244 | 158–168 | 184–190 | 223–233 | 1–121 | 26–35 | 50–66 | 99–110 | GLDVYAIYGLDV (SEQ ID NO: 3176) |
| I079D01 | 1925 | 144–254 | 166–179 | 195–201 | 234–243 | 1–128 | 26–35 | 50–66 | 99–117 | EVRNYDLLTRSYLAGPLDN (SEQ ID NO: 2751) |
| I079D02 | 1926 | 135–245 | 157–169 | 185–191 | 224–234 | 1–119 | 26–35 | 50–66 | 99–108 | EIGWEGAFDI (SEQ ID NO: 3178) |
| I079D04 | 1927 | 133–243 | 155–167 | 183–189 | 222–232 | 1–117 | 26–35 | 50–66 | 99–106 | VRPGLMDV (SEQ ID NO: 3132) |
| I079D06 | 1928 | 137–247 | 159–171 | 187–193 | 226–236 | 1–121 | 26–35 | 50–66 | 99–110 | EAYTSSWAEFDF (SEQ ID NO: 3190) |
| I079D07 | 1929 | 136–243 | 157–167 | 183–189 | 222–232 | 1–120 | 26–35 | 50–66 | 99–109 | NITPLAMVGDF (SEQ ID NO: 3146) |
| I079D08 | 1930 | 130–240 | 152–165 | 181–187 | 220–229 | 1–114 | 26–35 | 50–66 | 99–103 | LIEDF (SEQ ID NO: 3161) |
| I079D09 | 1931 | 131–238 | 152–162 | 178–184 | 217–227 | 1–115 | 26–35 | 50–66 | 99–104 | DSGSPD (SEQ ID NO: 3108) |
| I079D11 | 1932 | 134–241 | 157–167 | 183–189 | 222–230 | 1–118 | 26–35 | 50–66 | 99–107 | EGVAAGEDY (SEQ ID NO: 3123) |
| I079E06 | 1933 | 136–244 | 158–168 | 184–190 | 223–233 | 1–120 | 26–35 | 50–66 | 99–109 | EKRGSRRVFDI (SEQ ID NO: 3093) |
| I079E08 | 1934 | 137–247 | 159–171 | 187–193 | 226–236 | 1–121 | 26–35 | 50–66 | 99–110 | EAYASSWAEFDF (SEQ ID NO: 3189) |
| I079E11 | 1935 | 136–243 | 159–169 | 185–191 | 224–232 | 1–120 | 26–35 | 50–66 | 99–109 | PYGSGSYAFDI (SEQ ID NO: 3185) |
| I079E12 | 1936 | 143–253 | 165–177 | 193–199 | 232–242 | 1–127 | 26–35 | 50–66 | 99–116 | ARDYYDSSGYYVPDAFDI (SEQ ID NO: 3107) |
| I079F01 | 1937 | 133–241 | 154–164 | 180–186 | 219–230 | 1–117 | 26–35 | 50–66 | 99–106 | GHFYGMDV (SEQ ID NO: 3098) |
| I079F02 | 1938 | 148–253 | 169–179 | 195–201 | 234–242 | 1–132 | 26–35 | 50–68 | 101–121 | LPPDLRYGDGGMCSGFDWLGP (SEQ ID NO: 3219) |
| I079F03 | 1939 | 140–247 | 161–171 | 187–193 | 226–236 | 1–124 | 26–35 | 50–66 | 99–113 | ESLLTEEYCGSDCYS (SEQ ID NO: 3115) |
| I079F04 | 1940 | 136–243 | 157–167 | 183–189 | 222–232 | 1–120 | 26–35 | 50–66 | 99–109 | NSAPPAPSMDV (SEQ ID NO: 3099) |
| I079F09 | 1941 | 130–237 | 151–161 | 177–183 | 216–226 | 1–114 | 26–35 | 50–66 | 99–103 | RYYDY (SEQ ID NO: 3139) |
| I079F10 | 1942 | 136–243 | 157–167 | 183–189 | 222–232 | 1–120 | 26–35 | 50–66 | 99–109 | NITPLAMVGDF (SEQ ID NO: 3146) |
| I079F12 | 1943 | 136–243 | 159–169 | 185–191 | 224–232 | 1–120 | 26–35 | 50–66 | 99–109 | ADYSNDYYMDV (SEQ ID NO: 3166) |
| I079G02 | 1944 | 136–243 | 157–167 | 183–189 | 222–232 | 1–120 | 26–35 | 50–66 | 99–109 | NITPLAMVGDF (SEQ ID NO: 3146) |
| I079G05 | 1945 | 136–243 | 159–169 | 185–191 | 224–232 | 1–120 | 26–35 | 50–66 | 99–109 | FPLESYYYMDV (SEQ ID NO: 3124) |
| I079G06 | 1946 | 135–245 | 157–170 | 186–192 | 225–234 | 1–119 | 26–35 | 50–66 | 99–108 | GNSFGRTLDY (SEQ ID NO: 3158) |
| I079H05 | 1947 | 136–243 | 157–167 | 183–189 | 222–232 | 1–120 | 26–35 | 50–66 | 99–109 | DVPPPDGYLEV (SEQ ID NO: 3192) |
| I079H06 | 1948 | 134–241 | 157–167 | 183–189 | 222–230 | 1–118 | 26–35 | 50–66 | 99–107 | ASYPVPFDY (SEQ ID NO: 3171) |
| I080A01 | 1949 | 131–242 | 154–166 | 182–188 | 221–231 | 1–115 | 26–35 | 50–66 | 99–104 | GGWLDD (SEQ ID NO: 3210) |
| I080A02 | 1950 | 133–245 | 156–169 | 185–191 | 224–234 | 1–117 | 26–35 | 50–66 | 99–106 | EHSSSFDY (SEQ ID NO: 3111) |
| I080A05 | 1951 | 141–253 | 164–177 | 193–199 | 232–242 | 1–125 | 26–35 | 50–66 | 99–114 | EGEGDGYNVAPYYFDY (SEQ ID NO: 3160) |
| I080A06 | 1952 | 141–250 | 166–176 | 192–198 | 231–239 | 1–125 | 26–35 | 50–66 | 99–114 | EAGGSGSYHFSFPFDY (SEQ ID NO: 3188) |
| I080A07 | 1953 | 135–247 | 158–171 | 187–193 | 226–236 | 1–119 | 26–35 | 50–66 | 99–108 | TGIWGYYFDY (SEQ ID NO: 3175) |
| I080A10 | 1954 | 141–252 | 164–176 | 192–198 | 231–241 | 1–125 | 26–35 | 50–66 | 99–114 | DGNLNYDGSTDYGMDV (SEQ ID NO: 3140) |
| I080B02 | 1955 | 138–248 | 162–172 | 188–194 | 227–237 | 1–122 | 26–35 | 50–66 | 99–111 | LGRNYTSSWSLDY (SEQ ID NO: 3181) |
| I080B03 | 1956 | 138–249 | 161–173 | 189–195 | 228–238 | 1–122 | 26–35 | 50–66 | 99–111 | VVGGYSSTLGTDV (SEQ ID NO: 3096) |
| I080B05 | 1957 | 137–249 | 161–173 | 189–195 | 228–238 | 1–121 | 26–35 | 50–66 | 99–110 | LGVARGREAFDL (SEQ ID NO: 3206) |
| I080B06 | 1958 | 142–254 | 165–177 | 193–199 | 232–243 | 1–126 | 26–37 | 52–69 | 102–115 | AVRSPGYYYYYMDV (SEQ ID NO: 3125) |
| I080B07 | 1959 | 133–243 | 157–167 | 183–189 | 222–232 | 1–117 | 26–35 | 50–66 | 99–106 | GRKPLFDY (SEQ ID NO: 3141) |
| I080B08 | 1960 | 136–248 | 159–172 | 188–194 | 227–237 | 1–120 | 26–37 | 52–67 | 100–109 | KQRREKYFDY (SEQ ID NO: 3100) |

TABLE 1-continued scFvs that Immunospecifically Bind to BLyS

| Clone ID | scFv SEQ ID NO | AAs of VL | AAs of VL CDR1 | AAs of VL CDR2 | AAs of VL CDR3 | AAs of VH | AAs of VH CDR1 | AAs of VH CDR2 | AAs of VH CDR3 | VH CDR3 Sequence (SEQ ID NO) |
|---|---|---|---|---|---|---|---|---|---|---|
| I080B09 | 1961 | 142–254 | 165–178 | 194–200 | 233–243 | 1–126 | 26–35 | 50–66 | 99–115 | EKAIIETTSGEADPFDI (SEQ ID NO: 3151) |
| I080B10 | 1962 | 138–249 | 161–173 | 189–195 | 228–238 | 1–122 | 26–37 | 52–67 | 100–111 | RPALRSLWYFDL (SEQ ID NO: 3102) |
| I080B11 | 1963 | 137–248 | 160–172 | 188–194 | 227–237 | 1–121 | 26–35 | 50–68 | 101–110 | LHCTGGSCGF (SEQ ID NO: 3186) |
| I080B12 | 1964 | 139–253 | 164–179 | 195–201 | 234–242 | 1–123 | 26–35 | 50–66 | 99–112 | NPYYYDSSEGFFDY (SEQ ID NO: 3109) |
| I080C03 | 1965 | 138–248 | 162–172 | 188–194 | 227–237 | 1–122 | 26–35 | 50–66 | 99–111 | SGRQAYYYYGMDV (SEQ ID NO: 3091) |
| I080C06 | 1966 | 144–254 | 168–178 | 194–200 | 233–243 | 1–128 | 26–36 | 51–66 | 99–117 | DYYDGSSYSSGDYYYYMDV (SEQ ID NO: 3227) |
| I080C07 | 1967 | 144–256 | 167–180 | 196–202 | 235–245 | 1–128 | 26–35 | 50–66 | 99–117 | DSDLVVIPTAIQGRYYFDN (SEQ ID NO: 3113) |
| I080C08 | 1968 | 137–249 | 160–173 | 189–195 | 228–238 | 1–121 | 26–35 | 50–66 | 99–110 | GKRYSYGWYFDI (SEQ ID NO: 3130) |
| I080C10 | 1969 | 131–243 | 154–167 | 183–189 | 222–232 | 1–115 | 26–35 | 50–66 | 99–104 | DTPLDP (SEQ ID NO: 3094) |
| I080C11 | 1970 | 137–249 | 160–173 | 189–195 | 228–238 | 1–121 | 26–35 | 50–66 | 99–110 | EGDPTDNDAFDV (SEQ ID NO: 3155) |
| I080C12 | 1971 | 138–249 | 161–173 | 189–195 | 228–238 | 1–122 | 26–35 | 50–66 | 99–111 | DGPTYARPYYLDH (SEQ ID NO: 3153) |
| I080D01 | 1972 | 136–245 | 161–171 | 187–193 | 226–234 | 1–120 | 26–35 | 50–66 | 99–109 | DGTKYDWGFDY (SEQ ID NO: 3220) |
| I080D02 | 1973 | 141–254 | 164–177 | 193–199 | 232–243 | 1–125 | 26–35 | 50–66 | 99–114 | ETFSHCSGGSCYPFDY (SEQ ID NO: 3212) |
| I080D04 | 1974 | 138–248 | 162–172 | 188–194 | 227–237 | 1–122 | 26–35 | 50–66 | 99–111 | SGRQAYYYYGMDV (SEQ ID NO: 3091) |
| I080D05 | 1975 | 136–246 | 160–170 | 186–192 | 225–235 | 1–120 | 26–35 | 50–66 | 99–109 | EFFGYVYLTDY (SEQ ID NO: 3165) |
| I080D08 | 1976 | 137–248 | 160–172 | 188–194 | 227–237 | 1–121 | 26–35 | 50–68 | 101–110 | LHCTGGSCGF (SEQ ID NO: 3186) |
| I080D09 | 1977 | 138–250 | 161–174 | 190–196 | 229–239 | 1–122 | 26–35 | 50–66 | 99–111 | VDYTDYEMGAFEI (SEQ ID NO: 3187) |
| I080D11 | 1978 | 135–247 | 158–171 | 187–193 | 226–236 | 1–119 | 26–35 | 50–66 | 99–108 | VGNFGYYFEY (SEQ ID NO: 3196) |
| I080D12 | 1979 | 135–245 | 159–169 | 185–191 | 224–234 | 1–119 | 26–35 | 50–68 | 101–108 | SSRNGGDY (SEQ ID NO: 3214) |
| I080E01 | 1980 | 136–246 | 160–170 | 186–192 | 225–235 | 1–120 | 26–35 | 50–66 | 99–109 | DLSRVAGRFDY (SEQ ID NO: 3164) |
| I080E04 | 1981 | 136–247 | 159–171 | 187–193 | 226–236 | 1–120 | 26–37 | 52–67 | 100–109 | HDVYGDLFDY (SEQ ID NO: 3211) |
| I080E06 | 1982 | 137–248 | 160–172 | 188–194 | 227–237 | 1–121 | 26–35 | 50–68 | 101–110 | LHCSGGSCGF (SEQ ID NO: 3221) |
| I080E07 | 1983 | 142–254 | 165–178 | 194–200 | 233–243 | 1–126 | 26–35 | 50–66 | 99–115 | EGSIVGATLTINDAFDI (SEQ ID NO: 3150) |
| I080E08 | 1984 | 137–249 | 160–173 | 189–195 | 228–238 | 1–121 | 26–35 | 50–66 | 99–110 | GKRYSYGWYFDI (SEQ ID NO: 3130) |
| I080E12 | 1985 | 130–242 | 154–166 | 182–188 | 221–231 | 1–114 | 26–35 | 50–66 | 99–103 | DPFDY (SEQ ID NO: 3134) |
| I080F04 | 1986 | 138–249 | 161–173 | 189–195 | 228–238 | 1–122 | 26–35 | 50–66 | 99–111 | DGPTYARPYYLDH (SEQ ID NO: 3153) |
| I080F05 | 1987 | 142–253 | 165–177 | 193–199 | 232–242 | 1–126 | 26–35 | 50–66 | 99–115 | ESSGTLGEFSLELPFDY (SEQ ID NO: 3203) |
| I080F06 | 1988 | 138–248 | 162–172 | 188–194 | 227–237 | 1–122 | 26–35 | 50–66 | 99–111 | LGRNYTSSWSLDY (SEQ ID NO: 3181) |
| I080F08 | 1989 | 130–240 | 154–164 | 180–186 | 219–229 | 1–114 | 26–35 | 50–66 | 99–103 | NAFDY (SEQ ID NO: 3121) |
| I080G03 | 1990 | 140–250 | 164–174 | 190–196 | 229–239 | 1–124 | 26–36 | 51–66 | 99–113 | GRGYSSSSSVYGMDI (SEQ ID NO: 3095) |
| I080G04 | 1991 | 131–244 | 156–171 | 187–193 | 226–233 | 1–115 | 26–35 | 50–66 | 99–104 | VHSSGS (SEQ ID NO: 3216) |
| I080G10 | 1992 | 143–252 | 167–177 | 193–199 | 232–241 | 1–127 | 26–35 | 50–66 | 99–116 | KRGDFGVIRLHHYYGMDV (SEQ ID NO: 3136) |
| I080G11 | 1993 | 136–247 | 159–171 | 187–193 | 226–236 | 1–120 | 26–37 | 52–67 | 100–109 | HDVYGDLFDS (SEQ ID NO: 3205) |
| I080H01 | 1994 | 140–252 | 164–176 | 192–198 | 231–241 | 1–124 | 26–37 | 52–67 | 100–113 | LRPDADYGDYGFDY (SEQ ID NO: 3218) |
| I080H02 | 1995 | 139–248 | 162–172 | 188–194 | 227–237 | 1–123 | 26–35 | 50–66 | 99–112 | TSERGTYRQWDFDN (SEQ ID NO: 3204) |
| I080H03 | 1996 | 135–246 | 158–170 | 186–192 | 225–235 | 1–119 | 26–35 | 50–66 | 99–108 | EAGEVAAIDY (SEQ ID NO: 3180) |
| I080H04 | 1997 | 137–249 | 160–173 | 189–195 | 228–238 | 1–121 | 26–35 | 50–66 | 99–110 | GKRYSYGWYFDI (SEQ ID NO: 3130) |
| I080H05 | 1998 | 136–247 | 159–171 | 187–193 | 226–236 | 1–120 | 26–37 | 52–67 | 100–109 | HDVYGDLFDS (SEQ ID NO: 3205) |
| I080H06 | 1999 | 137–249 | 160–173 | 189–195 | 228–238 | 1–121 | 26–35 | 50–66 | 99–110 | GKRYSYGWYFDV (SEQ ID NO: 3217) |
| I080H07 | 2000 | 137–248 | 160–172 | 188–194 | 227–237 | 1–121 | 26–35 | 50–68 | 101–110 | LHCTGGSCGF (SEQ ID NO: 3186) |
| I080H08 | 2001 | 138–251 | 162–175 | 191–197 | 230–240 | 1–122 | 26–35 | 50–66 | 99–111 | ERGGRDGDYALDF (SEQ ID NO: 3148) |
| I080H09 | 2002 | 139–249 | 163–173 | 189–195 | 228–238 | 1–123 | 26–36 | 51–66 | 99–112 | RTPDHNGDSGPPDY (SEQ ID NO: 3215) |
| I081A01 | 2003 | 130–237 | 153–163 | 179–185 | 218–226 | 1–114 | 26–35 | 50–66 | 99–103 | DTTDY (SEQ ID NO: 2203) |
| I081A03 | 2004 | 135–245 | 157–170 | 186–192 | 225–234 | 1–119 | 26–35 | 50–66 | 99–108 | ESLTGGAFDI (SEQ ID NO: 3117) |
| I081A04 | 2005 | 130–237 | 153–163 | 179–185 | 218–226 | 1–114 | 26–35 | 50–66 | 99–103 | DTTDY (SEQ ID NO: 2203) |
| I081A06 | 2006 | 130–237 | 151–161 | 177–183 | 216–226 | 1–114 | 26–35 | 50–66 | 99–103 | DTTDY (SEQ ID NO: 2203) |

TABLE 1-continued scFvs that Immunospecifically Bind to BLyS

| Clone ID | scFv SEQ ID NO | AAs of VL | AAs of VL CDR1 | AAs of VL CDR2 | AAs of VL CDR3 | AAs of VH | AAs of VH CDR1 | AAs of VH CDR2 | AAs of VH CDR3 | VH CDR3 Sequence (SEQ ID NO) |
|---|---|---|---|---|---|---|---|---|---|---|
| I081A08 | 2007 | 130–240 | 152–164 | 180–186 | 219–229 | 1–114 | 26–35 | 50–66 | 99–103 | DTTDY (SEQ ID NO: 2203) |
| I081A09 | 2008 | 134–241 | 155–165 | 181–187 | 220–230 | 1–118 | 26–35 | 50–66 | 99–107 | GAGSRYFDL (SEQ ID NO: 3118) |
| I081A10 | 2009 | 133–243 | 155–168 | 184–190 | 223–232 | 1–117 | 26–35 | 50–66 | 99–106 | GGDRAFDI (SEQ ID NO: 3119) |
| I081B01 | 2010 | 130–236 | 151–161 | 177–183 | 216–225 | 1–114 | 26–35 | 50–66 | 99–103 | DTTDY (SEQ ID NO: 2203) |
| I081B04 | 2011 | 134–244 | 156–169 | 185–191 | 224–233 | 1–118 | 26–35 | 50–66 | 99–107 | GNAWGAFDI (SEQ ID NO: 2211) |
| I081B05 | 2012 | 133–243 | 155–168 | 184–190 | 223–232 | 1–117 | 26–35 | 50–66 | 99–106 | GGDRAFDI (SEQ ID NO: 3119) |
| I081B06 | 2013 | 133–240 | 154–164 | 180–186 | 219–229 | 1–117 | 26–35 | 50–66 | 99–106 | VKRYYFDY (SEQ ID NO: 3179) |
| I081B07 | 2014 | 136–243 | 157–167 | 183–189 | 222–232 | 1–120 | 26–35 | 50–66 | 99–109 | ELTGANDAFDI (SEQ ID NO: 3104) |
| I081B08 | 2015 | 132–239 | 153–163 | 179–185 | 218–228 | 1–116 | 26–35 | 50–66 | 99–105 | RRYALDY (SEQ ID NO: 2920) |
| I081B09 | 2016 | 130–240 | 152–164 | 180–186 | 219–229 | 1–114 | 26–35 | 50–66 | 99–103 | DTTDY (SEQ ID NO: 2203) |
| I081B10 | 2017 | 130–237 | 153–163 | 179–185 | 218–226 | 1–114 | 26–35 | 50–66 | 99–103 | DTTDY (SEQ ID NO: 2203) |
| I081B11 | 2018 | 132–239 | 153–163 | 179–185 | 218–228 | 1–116 | 26–35 | 50–66 | 99–105 | GFALYKD (SEQ ID NO: 3169) |
| I081C07 | 2019 | 130–237 | 153–163 | 179–185 | 218–226 | 1–114 | 26–35 | 50–66 | 99–103 | DTTDY (SEQ ID NO: 2203) |
| I081C08 | 2020 | 130–237 | 153–163 | 179–185 | 218–226 | 1–114 | 26–35 | 50–66 | 99–103 | DTTDY (SEQ ID NO: 2203) |
| I081D04 | 2021 | 135–242 | 156–166 | 182–188 | 221–231 | 1–119 | 26–35 | 50–66 | 99–108 | EDLTGDAFDI (SEQ ID NO: 3103) |
| I081D06 | 2022 | 132–239 | 153–163 | 179–185 | 218–228 | 1–116 | 26–35 | 50–66 | 99–105 | GDAYFDY (SEQ ID NO: 3147) |
| I081D08 | 2023 | 132–239 | 153–163 | 179–185 | 218–228 | 1–116 | 26–35 | 50–66 | 99–105 | GDAYFDY (SEQ ID NO: 3147) |
| I081D09 | 2024 | 130–238 | 152–162 | 178–184 | 217–227 | 1–114 | 26–35 | 50–66 | 99–103 | DTTDY (SEQ ID NO: 2203) |
| I081D10 | 2025 | 130–240 | 152–164 | 180–186 | 219–229 | 1–114 | 26–35 | 50–66 | 99–103 | DTTDY (SEQ ID NO: 2203) |
| I081D11 | 2026 | 134–244 | 156–169 | 185–191 | 224–233 | 1–118 | 26–35 | 50–66 | 99–107 | EGLLDAFDI (SEQ ID NO: 3200) |
| I081D12 | 2027 | 130–237 | 153–163 | 179–185 | 218–226 | 1–114 | 26–35 | 50–66 | 99–103 | DTTDY (SEQ ID NO: 2203) |
| I081E02 | 2028 | 130–237 | 153–163 | 179–185 | 218–226 | 1–114 | 26–35 | 50–66 | 99–103 | DTTDY (SEQ ID NO: 2203) |
| I081E03 | 2029 | 130–240 | 152–164 | 180–186 | 219–229 | 1–114 | 26–35 | 50–66 | 99–103 | DTTDY (SEQ ID NO: 2203) |
| I081E05 | 2030 | 130–240 | 152–164 | 180–186 | 219–229 | 1–114 | 26–35 | 50–66 | 99–103 | DTTDY (SEQ ID NO: 2203) |
| I081E06 | 2031 | 134–241 | 155–165 | 181–187 | 220–230 | 1–118 | 26–35 | 50–66 | 99–107 | VGYGGKGDY (SEQ ID NO: 3137) |
| I081E07 | 2032 | 134–241 | 155–165 | 181–187 | 220–230 | 1–118 | 26–35 | 50–66 | 99–107 | GAGSRYFDL (SEQ ID NO: 3118) |
| I081E10 | 2033 | 142–249 | 163–173 | 189–195 | 228–238 | 1–126 | 26–35 | 50–66 | 99–115 | GLAPIVDGGMTNDAFDI (SEQ ID NO: 3184) |
| I081F01 | 2034 | 130–239 | 152–164 | 180–186 | 219–228 | 1–114 | 26–35 | 50–66 | 99–103 | DTTDY (SEQ ID NO: 2203) |
| I081F04 | 2035 | 132–239 | 153–163 | 179–185 | 218–228 | 1–116 | 26–35 | 50–66 | 99–105 | RLIRKAR (SEQ ID NO: 3170) |
| I081F05 | 2036 | 130–237 | 151–161 | 177–183 | 216–226 | 1–114 | 26–35 | 50–66 | 99–103 | DTTDY (SEQ ID NO: 2203) |
| I081F06 | 2037 | 134–244 | 156–169 | 185–191 | 224–233 | 1–118 | 26–35 | 50–66 | 99–107 | ERGNQAFDI (SEQ ID NO: 3156) |
| I081F07 | 2038 | 132–239 | 153–163 | 179–185 | 218–228 | 1–116 | 26–35 | 50–66 | 99–105 | RRYALDY (SEQ ID NO: 2920) |
| I081F11 | 2039 | 130–237 | 151–161 | 177–183 | 216–226 | 1–114 | 26–35 | 50–66 | 99–103 | DTTDY (SEQ ID NO: 2203) |
| I081G01 | 2040 | 130–237 | 153–163 | 179–185 | 218–226 | 1–114 | 26–35 | 50–66 | 99–103 | DTTDY (SEQ ID NO: 2203) |
| I081G04 | 2041 | 130–240 | 152–164 | 180–186 | 219–229 | 1–114 | 26–35 | 50–66 | 99–103 | DTTDY (SEQ ID NO: 2203) |
| I081G06 | 2042 | 135–245 | 157–170 | 186–192 | 225–234 | 1–119 | 26–35 | 50–66 | 99–108 | SRSPYDAFDI (SEQ ID NO: 3097) |
| I081G10 | 2043 | 130–237 | 153–163 | 179–185 | 218–226 | 1–114 | 26–35 | 50–66 | 99–103 | DTTDY (SEQ ID NO: 2203) |
| I081H02 | 2044 | 130–240 | 152–164 | 180–186 | 219–229 | 1–114 | 26–35 | 50–66 | 99–103 | DTTDY (SEQ ID NO: 2203) |
| I081H03 | 2045 | 130–240 | 152–164 | 180–186 | 219–229 | 1–114 | 26–35 | 50–66 | 99–103 | DTTDY (SEQ ID NO: 2203) |
| I081H04 | 2046 | 135–242 | 156–166 | 182–188 | 221–231 | 1–119 | 26–35 | 50–66 | 99–108 | SNWGGDAFDI (SEQ ID NO: 3202) |
| I081H06 | 2047 | 130–240 | 152–165 | 181–187 | 220–229 | 1–114 | 26–35 | 50–66 | 99–103 | LAFDI (SEQ ID NO: 3174) |
| I081H08 | 2048 | 130–240 | 152–164 | 180–186 | 219–229 | 1–114 | 26–35 | 50–66 | 99–103 | DTTDY (SEQ ID NO: 2203) |
| I082A02 | 2049 | 139–249 | 161–173 | 189–195 | 228–238 | 1–123 | 26–35 | 50–66 | 99–112 | PAASSRGPKDAFDI (SEQ ID NO: 3129) |
| I082A04 | 2050 | 130–240 | 152–165 | 181–187 | 220–229 | 1–114 | 26–35 | 50–66 | 99–103 | LSGDS (SEQ ID NO: 3122) |
| I082A08 | 2051 | 134–243 | 156–168 | 184–190 | 223–232 | 1–118 | 26–35 | 50–66 | 99–107 | EGVAAGEDY (SEQ ID NO: 3123) |
| I082A11 | 2052 | 130–240 | 152–165 | 181–187 | 220–229 | 1–114 | 26–35 | 50–66 | 99–103 | FVLDY (SEQ ID NO: 2210) |

TABLE 1-continued scFvs that Immunospecifically Bind to BLyS

| Clone ID | scFv SEQ ID NO | AAs of VL | AAs of VL CDR1 | AAs of VL CDR2 | AAs of VL CDR3 | AAs of VH | AAs of VH CDR1 | AAs of VH CDR2 | AAs of VH CDR3 | VH CDR3 Sequence (SEQ ID NO) |
|---|---|---|---|---|---|---|---|---|---|---|
| I082B06 | 2053 | 131–238 | 154–164 | 180–186 | 219–227 | 1–115 | 26–35 | 50–66 | 99–104 | GNGKDV (SEQ ID NO: 3135) |
| I082B09 | 2054 | 134–241 | 157–167 | 183–189 | 222–230 | 1–118 | 26–35 | 50–66 | 99–107 | EGVAAGEDY (SEQ ID NO: 3123) |
| I082B12 | 2055 | 131–241 | 153–166 | 182–188 | 221–230 | 1–115 | 26–35 | 50–66 | 99–104 | DLDFDY (SEQ ID NO: 2208) |
| I082C01 | 2056 | 136–243 | 157–167 | 183–189 | 222–232 | 1–120 | 26–35 | 50–66 | 99–109 | VNDIVVVDMDV (SEQ ID NO: 3143) |
| I082C05 | 2057 | 136–243 | 157–167 | 183–189 | 222–232 | 1–120 | 26–35 | 50–66 | 99–109 | EKRGSRRVFDI (SEQ ID NO: 3093) |
| I082C08 | 2058 | 137–244 | 158–168 | 184–190 | 223–233 | 1–121 | 26–35 | 50–66 | 99–110 | LSNRNDNLRLDY (SEQ ID NO: 3106) |
| I082D02 | 2059 | 130–240 | 152–165 | 181–187 | 220–229 | 1–114 | 26–35 | 50–66 | 99–103 | FVLDY (SEQ ID NO: 2210) |
| I082E05 | 2060 | 134–241 | 155–165 | 181–187 | 220–230 | 1–118 | 26–35 | 50–66 | 99–107 | TWATNTFDM (SEQ ID NO: 3152) |
| I082E06 | 2061 | 130–240 | 152–165 | 181–187 | 220–229 | 1–114 | 26–35 | 50–66 | 99–103 | FDLDY (SEQ ID NO: 3167) |
| I082E07 | 2062 | 139–246 | 162–172 | 188–194 | 227–235 | 1–123 | 26–35 | 50–66 | 99–112 | VEWEDIVVGSAFDI (SEQ ID NO: 3128) |
| I082F11 | 2063 | 136–243 | 159–169 | 185–191 | 224–232 | 1–120 | 26–35 | 50–66 | 99–109 | GGDMTTVTTDY (SEQ ID NO: 3177) |
| I082G07 | 2064 | 136–243 | 159–169 | 185–191 | 224–232 | 1–120 | 26–35 | 50–66 | 99–109 | ADYSNDYYMDV (SEQ ID NO: 3166) |
| I082G10 | 2065 | 134–249 | 160–173 | 189–195 | 228–238 | 1–118 | 26–35 | 50–66 | 99–107 | EGVAAGEDY (SEQ ID NO: 3123) |
| I082G11 | 2066 | 143–250 | 164–174 | 190–196 | 229–239 | 1–127 | 26–35 | 50–66 | 99–116 | GPIYYFDGSAYEGYYFDY (SEQ ID NO: 3222) |
| I082H04 | 2067 | 132–238 | 153–163 | 179–185 | 218–227 | 1–116 | 26–35 | 50–65 | 98–105 | MNADAFEI (SEQ ID NO: 3223) |
| I082H09 | 2068 | 139–246 | 160–170 | 186–192 | 225–235 | 1–123 | 26–35 | 50–66 | 99–112 | PAASSRGPKDAFDI (SEQ ID NO: 3129) |
| I083A06 | 2069 | 136–244 | 159–169 | 185–191 | 224–233 | 1–120 | 26–35 | 50–66 | 99–109 | DSRPTNRAFHY (SEQ ID NO: 3110) |
| I083A09 | 2070 | 137–248 | 160–172 | 188–194 | 227–237 | 1–121 | 26–35 | 50–68 | 101–110 | LHCTGGSCGF (SEQ ID NO: 3186) |
| I083A11 | 2071 | 135–248 | 158–171 | 187–193 | 226–237 | 1–119 | 26–35 | 50–66 | 99–108 | VRDDSAGFDY (SEQ ID NO: 3173) |
| I083B03 | 2072 | 137–247 | 161–171 | 187–193 | 226–236 | 1–121 | 26–35 | 50–66 | 99–110 | VLVRGQYRGMDL (SEQ ID NO: 3138) |
| I083B05 | 2073 | 138–250 | 161–174 | 190–196 | 229–239 | 1–122 | 26–35 | 50–66 | 99–111 | VDYTDYEMGAFDL (SEQ ID NO: 3172) |
| I083B06 | 2074 | 138–250 | 161–174 | 190–196 | 229–239 | 1–122 | 26–35 | 50–66 | 99–111 | DRIAAAGGDAFDI (SEQ ID NO: 3194) |
| I083B10 | 2075 | 137–246 | 162–172 | 188–194 | 227–235 | 1–121 | 26–35 | 50–66 | 99–110 | DLYKNGYALFDS (SEQ ID NO: 3197) |
| I083C01 | 2076 | 135–247 | 158–171 | 187–193 | 226–236 | 1–119 | 26–35 | 50–66 | 99–108 | DEYSSLYMDV (SEQ ID NO: 3201) |
| I083C02 | 2077 | 135–246 | 158–171 | 187–193 | 226–235 | 1–119 | 26–35 | 50–66 | 99–108 | FGAGRLYDDY (SEQ ID NO: 3224) |
| I083C07 | 2078 | 136–249 | 159–172 | 188–194 | 227–238 | 1–120 | 26–35 | 50–66 | 99–109 | DNGGGTIGFDY (SEQ ID NO: 2195) |
| I083C12 | 2079 | 135–246 | 158–171 | 187–193 | 226–235 | 1–119 | 26–35 | 50–66 | 99–108 | DQGIETANDY (SEQ ID NO: 3207) |
| I083D04 | 2080 | 145–256 | 168–181 | 197–203 | 236–245 | 1–129 | 26–35 | 50–66 | 99–118 | DILPDYDFWNPNEDASSLDT (SEQ ID NO: 3133) |
| I083D07 | 2081 | 148–262 | 173–188 | 204–210 | 243–251 | 1–132 | 26–35 | 50–66 | 99–121 | DFQMVRGVFIANPPIYNYYGMDV (SEQ ID NO: 3154) |
| I083D08 | 2082 | 142–254 | 165–178 | 194–200 | 233–243 | 1–126 | 26–35 | 50–66 | 99–115 | DADEGLVEAETTNWFDS (SEQ ID NO: 3126) |
| I083D10 | 2083 | 146–258 | 169–181 | 197–203 | 236–247 | 1–130 | 26–37 | 52–69 | 102–119 | ATKSYDILTRMYYYHMDV (SEQ ID NO: 2748) |
| I083D12 | 2084 | 132–242 | 156–166 | 182–188 | 221–231 | 1–116 | 26–35 | 50–66 | 99–105 | DRTRMDV (SEQ ID NO: 3182) |
| I083E02 | 2085 | 138–249 | 161–173 | 189–195 | 228–238 | 1–122 | 26–35 | 50–66 | 99–111 | VGIKAAAVDNFEY (SEQ ID NO: 2197) |
| I083E03 | 2086 | 135–248 | 158–171 | 187–193 | 226–237 | 1–119 | 26–35 | 50–66 | 99–108 | DEIYNDAFDY (SEQ ID NO: 3105) |
| I083E04 | 2087 | 143–255 | 166–179 | 195–201 | 234–244 | 1–127 | 26–35 | 50–66 | 99–116 | DGDISDSPINNQNYAMDI (SEQ ID NO: 3101) |
| I083E08 | 2088 | 138–248 | 162–172 | 188–194 | 227–237 | 1–122 | 26–35 | 50–66 | 99–111 | RGGTSENYSGMDV (SEQ ID NO: 3209) |
| I083E12 | 2089 | 134–245 | 157–170 | 186–192 | 225–234 | 1–118 | 26–35 | 50–66 | 99–107 | DYPHNAFDI (SEQ ID NO: 3127) |
| I083F02 | 2090 | 145–258 | 168–181 | 197–203 | 236–247 | 1–129 | 26–35 | 50–66 | 99–118 | DVRSDRFWSGGYFHYSGMDV (SEQ ID NO: 3131) |
| I083F04 | 2091 | 137–248 | 160–172 | 188–194 | 227–237 | 1–121 | 26–35 | 50–66 | 99–110 | STLEVGATDFDY (SEQ ID NO: 3199) |
| I083F06 | 2092 | 134–247 | 157–170 | 186–192 | 225–236 | 1–118 | 26–35 | 50–66 | 99–107 | SDDWGAYHI (SEQ ID NO: 3198) |
| I083F08 | 2093 | 138–250 | 161–174 | 190–196 | 229–239 | 1–122 | 26–35 | 50–66 | 99–111 | ERGGRDGDYALDF (SEQ ID NO: 3148) |
| I083F11 | 2094 | 136–248 | 159–172 | 188–194 | 227–237 | 1–120 | 26–35 | 50–66 | 99–109 | ELVGAPGGFDP (SEQ ID NO: 3191) |
| I083G04 | 2095 | 138–250 | 161–174 | 190–196 | 229–239 | 1–122 | 26–35 | 50–66 | 99–111 | VDYTDYEMGAFDL (SEQ ID NO: 3172) |
| I083G05 | 2096 | 137–249 | 161–173 | 189–195 | 228–238 | 1–121 | 26–35 | 50–68 | 101–110 | SVAGRGNFDY (SEQ ID NO: 3208) |
| I083G06 | 2097 | 138–250 | 161–174 | 190–196 | 229–239 | 1–122 | 26–35 | 50–66 | 99–111 | ERGGRDGDYALDF (SEQ ID NO: 3148) |
| I083G08 | 2098 | 141–253 | 164–177 | 193–199 | 232–242 | 1–125 | 26–35 | 50–66 | 99–114 | EGGGDAYDVAPYYFDY (SEQ ID NO: 2204) |

TABLE 1-continued scFvs that Immunospecifically Bind to BLyS

| Clone ID | scFv SEQ ID NO | AAs of VL | AAs of VL CDR1 | AAs of VL CDR2 | AAs of VL CDR3 | AAs of VH | AAs of VH CDR1 | AAs of VH CDR2 | AAs of VH CDR3 | VH CDR3 Sequence (SEQ ID NO) |
|---|---|---|---|---|---|---|---|---|---|---|
| I083G09 | 2099 | 130–242 | 154–166 | 182–188 | 221–231 | 1–114 | 26–35 | 50–66 | 99–103 | DPFDY (SEQ ID NO: 3134) |
| I083G11 | 2100 | 140–252 | 163–176 | 192–198 | 231–241 | 1–124 | 26–35 | 50–66 | 99–113 | ALLGLPSDFSYYVDV (SEQ ID NO: 3159) |
| I083H04 | 2101 | 141–253 | 164–177 | 193–199 | 232–242 | 1–125 | 26–35 | 50–66 | 99–114 | EGEGDGYNVAPYYFDY (SEQ ID NO: 3160) |
| I083H05 | 2102 | 133–243 | 157–167 | 183–189 | 222–232 | 1–117 | 26–35 | 50–66 | 99–106 | TDYGGFDY (SEQ ID NO: 3092) |
| I083H07 | 2103 | 137–247 | 161–171 | 187–193 | 226–236 | 1–121 | 26–35 | 50–66 | 99–110 | GGVGDSRGVFDP (SEQ ID NO: 3162) |
| I084A03 | 2104 | 130–237 | 153–163 | 179–185 | 218–226 | 1–114 | 26–35 | 50–66 | 99–103 | DTTDY (SEQ ID NO: 2203) |
| I084A08 | 2105 | 130–240 | 152–164 | 180–186 | 219–229 | 1–114 | 26–35 | 50–66 | 99–103 | DTTDY (SEQ ID NO: 2203) |
| I084B08 | 2106 | 135–242 | 156–166 | 182–188 | 221–231 | 1–119 | 26–35 | 50–66 | 99–108 | ESLTGDAFDI (SEQ ID NO: 3116) |
| I084C02 | 2107 | 136–243 | 157–167 | 183–189 | 222–232 | 1–120 | 26–35 | 50–66 | 99–109 | SPLHFSDAFDI (SEQ ID NO: 3120) |
| I084D03 | 2108 | 130–240 | 152–164 | 180–186 | 219–229 | 1–114 | 26–35 | 50–66 | 99–103 | DTTDY (SEQ ID NO: 2203) |
| I084D05 | 2109 | 133–243 | 155–168 | 184–190 | 223–232 | 1–117 | 26–35 | 50–66 | 99–106 | EVGGAFDI (SEQ ID NO: 3157) |
| I084E01 | 2110 | 130–237 | 153–163 | 179–185 | 218–226 | 1–114 | 26–35 | 50–66 | 99–103 | DTTDY (SEQ ID NO: 2203) |
| I084E06 | 2111 | 130–237 | 153–163 | 179–185 | 218–226 | 1–114 | 26–35 | 50–66 | 99–103 | DTTDY (SEQ ID NO: 2203) |
| I084E10 | 2112 | 130–237 | 151–161 | 177–183 | 216–226 | 1–114 | 26–35 | 50–66 | 99–103 | DTTDY (SEQ ID NO: 2203) |
| I084E12 | 2113 | 130–240 | 152–164 | 180–186 | 219–229 | 1–114 | 26–35 | 50–66 | 99–103 | DTTDY (SEQ ID NO: 2203) |
| I084F04 | 2114 | 130–237 | 153–163 | 179–185 | 218–226 | 1–114 | 26–35 | 50–66 | 99–103 | DTTDY (SEQ ID NO: 2203) |
| I084F07 | 2115 | 130–237 | 153–163 | 179–185 | 218–226 | 1–114 | 26–35 | 50–66 | 99–103 | DTTDY (SEQ ID NO: 2203) |
| I084F12 | 2116 | 135–245 | 157–170 | 186–192 | 225–234 | 1–119 | 26–35 | 50–66 | 99–108 | ESLTGDAFDI (SEQ ID NO: 3116) |
| I084G12 | 2117 | 130–240 | 152–164 | 180–186 | 219–229 | 1–114 | 26–35 | 50–66 | 99–103 | DTTDY (SEQ ID NO: 2203) |
| I084H02 | 2118 | 130–237 | 153–163 | 179–185 | 218–226 | 1–114 | 26–35 | 50–66 | 99–103 | DTTDY (SEQ ID NO: 2203) |
| I099B05 | 2119 | 145–256 | 168–180 | 196–202 | 235–245 | 1–129 | 26–35 | 50–66 | 99–118 | GAHYYDRSPSHLKSYWYFDL (SEQ ID NO: 3149) |
| I099G09 | 2120 | 138–249 | 161–173 | 189–195 | 228–238 | 1–122 | 26–35 | 50–66 | 99–111 | VGIKAAAVDNFEY (SEQ ID NO: 2197) |
| I099H01 | 2121 | 138–248 | 162–172 | 188–194 | 227–237 | 1–122 | 26–35 | 50–66 | 99–111 | LGRNYTSSWSLDY (SEQ ID NO: 3181) |
| I099H06 | 2122 | 138–249 | 161–173 | 189–195 | 228–238 | 1–122 | 26–35 | 50–66 | 99–111 | VGIKAAAVDNFEY (SEQ ID NO: 2197) |
| I099H08 | 2123 | 144–255 | 167–179 | 195–201 | 234–244 | 1–128 | 26–35 | 50–66 | 99–117 | GGRYGYYYDGTGYVDAFDI (SEQ ID NO: 3226) |
| I100A01 | 2124 | 136–247 | 159–172 | 188–194 | 227–236 | 1–120 | 26–35 | 50–66 | 99–109 | DNGGGTIGFDY (SEQ ID NO: 2195) |
| I100A10 | 2125 | 140–251 | 163–175 | 191–197 | 230–240 | 1–124 | 26–35 | 50–66 | 99–113 | VRQQIADPPRSFFDP (SEQ ID NO: 3144) |
| I100B03 | 2126 | 136–247 | 159–172 | 188–194 | 227–236 | 1–120 | 26–35 | 50–66 | 99–109 | DNGGGTIGFDY (SEQ ID NO: 2195) |
| I100B04 | 2127 | 136–247 | 159–172 | 188–194 | 227–236 | 1–120 | 26–35 | 50–66 | 99–109 | DNGGGTIGFDY (SEQ ID NO: 2195) |
| I100C03 | 2128 | 140–251 | 163–175 | 191–197 | 230–240 | 1–124 | 26–35 | 50–66 | 99–113 | VRQQIADPPRSFFDP (SEQ ID NO: 3144) |

SEQUENCE LISTING (3239 sequences)

SEQ ID NO: 1 - protein, 248 aa, Homo sapiens
QVQLLQSAAELKKPGQSLKISCKGSGFTFTTYWIGWVRQLPGKGLEWMGIIYPGDSHTTYSPSFEGHVNISVDKSINTAYLQWSSLKASDTAMYYCARHDDDVLTGYYFESWGQGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 2 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHYGMDVWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 3 - protein, 254 aa, Homo sapiens
QVQLQQSGPGLVKPSQILSLTCAISGDSVASNGAAWNWIRQSPSRGLEWLGRTYYRSKWYVDYAVSVKSRITINPDTSKNQFSLQLNSVTPEDTAVYYCARDRYDILTGYYYYGMDVWGQGTMVTVSSGGGGSGGGGSGGGGSQSALTQPASVSGSRGQSITISCTGTTGDVGGYDYVSWYQQHPGKAPKLLIYGNSNRPSGVPDRFSASKSGNTASLTISGLQAEDEADYFCSTYAPPGIIMFGGGTKLTVLG

SEQ ID NO: 4 - protein, 255 aa, Homo sapiens
RVQLVQSGAEVKKPGASVKVSCKASGYTFTSDHISWVRQAPGQGLEWMGWISPHHGKTNYAQKLQGRVTMTTDTSTSTAYMELRSLRSDDTAVYYCARVQMDSEYYDLLTGINVGPYYFDYWGKGTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 5 - protein, 249 aa, Homo sapiens
EVNLRESGGGVDQPGRSLRLSCAASGFTFSSYGMHWVRQAPGKGLEWVAVISYDGSNKYYADSVKGRFTISRDNSKNTLYLQMNSLRAEDTAVYYCAKDGYYDILTGYSYYGMDVWGQGPMVAVSSGGGGSGGGGSGGGGSSELTQDPAVSVALGQTVRITCQGDSLRSYYTNWFQQKPGQAPLLVVYAKNKRPSGIPDRFSGSSSGNTASLTITGAQAEDEADYYCNSRDSSGNHVVFGGGTKLTVLG

SEQ ID NO: 6 - protein, 251 aa, Homo sapiens
QVQLVQSGAEVRKPGSSVKVSCKASGGSFSSHVFSWVRQAPGQGLEWVGGITPKFATPNYAQKFQHRVTITADELTRTVFMDLSGLRSEDTAVYYCARGYDSSAFRAFDIWGQGTMVTVSSGGGGSGGGGSGGGGSAQSVLTQPPSVSGAPGQRVTISCTGSSSNIGAGYDVQWYQQLPGTAPKLLIHGNNNRPSGVPDRFSGSKSGTSASLAITGLQDEDEADYYCQSYDSSLSFSGYVFGTGTKVTVLG

SEQ ID NO: 7 - protein, 250 aa, Homo sapiens
EVQLVQSGAEVKKPGSSVKVSCKASGDTFSHYAINWVRQAPGQGLEWMGGIIPTFNAVKYAQKFQGRATITADGSTSTAYMELNSLRSEDTAVYYCATAPYDLLTHYFHYFDYWGQGTMVTVSSGGGGSGGGGSGGGGSALSSELTQDPAVSVTLGQTVRITCQGDSLRSYYPSWYQQKPGQAPVLVIYPKNIRPSGIPDRFSGSSSGNTASLTITGAQAEDEADYYCNSRASSGNHYVFATGTKLTVLG

SEQ ID NO: 8 - protein, 256 aa, Homo sapiens
QVQLQQSGAEVKKPGSSVKVSCRTSGGTFSNYGLSWVRQAPGQGLEWMGGVIPISSTIKYGQKFQDRLTIAADDLTNTTFMELSSLRPEDTAVYYCARAATTSQKHNKYAYYFYGMDVWGQGTMVTVSSGGGGSGGGGSGGGGSAQSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLVFGGGTKVTVLG

SEQ ID NO: 9 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 10 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQVWVAWGQGTMVTVSSGGGGSGGGGSGGGGSALETTLTQSPDTLSLSPGERATLSCRASQSVTRGWVAWYQQKPGQAPRLLMYGTSRRATGVPDRFSGSGSGTDFTLTISRLEPEDFAVYYCQQYATSPRTFGQGTRLEIKR

SEQ ID NO: 11 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQVWVAWGQGTMVTVSSGGGGSGGGGSGGGGSALETTLTQSPDTLSLSPGERATLSCRASQSVTRGWVAWYQQKPGQAPRLLMYGTSRRATGVPDRFSGSKSGTDFTLTISRLEPEDFAVYYCQQYATSPRTFGQGTRLEIKR

SEQ ID NO: 12 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTRYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSGSGTDFTLTISRLEPEDFAVYYCQQYATSPRTFGQGTRLEIKR

SEQ ID NO: 13 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTGYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSKSGTDFTLTISRLEPEDFAVYYCQQYATSPRTFGQGTRLEIKR

SEQ ID NO: 14 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTRYVFQVWVAWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 15 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTGYVFQVWVAWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 16 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTRYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSKSGTDFTLTISRLEPEDFAVYYCQQYATSPRTFGQGTRLEIKR

SEQ ID NO: 17 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTGYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSGSGTDFTLTISRLEPEDFAVYYCQQYATSPRTFGQGTRLEIKR

SEQ ID NO: 18 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTRYVFQVWVAWGQGTMVTVSSGGGGSGGGGSGGGGSALETTLTQSPDTLSLSPGERATLSCRASQSVTRGWVAWYQQKPGQAPRLLMYGTSRRATGVPDRFSGSKSGTDFTLTISRLEPEDFAVYYCQQYATSPRTFGQGTRLEIKR

SEQ ID NO: 19 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTRYVFQVWVAWGQGTMVTVSSGGGGSGGGGSGGGGSALETTLTQSPDTLSLSPGERATLSCRASQSVTRGWVAWYQQKPGQAPRLLMYGTSRRATGVPDRFSGSGSGTDFTLTISRLEPEDFAVYYCQQYATSPRTFGQGTRLEIKR

SEQ ID NO: 20 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTGYVFQVWVAWGQGTMVTVSSGGGGSGGGGSGGGGSALETTLTQSPDTLSLSPGERATLSCRASQSVTRGWVAWYQQKPGQAPRLLMYGTSRRATGVPDRFSGSKSGTDFTLTISRLEPEDFAVYYCQQYATSPRTFGQGTRLEIKR

SEQ ID NO: 21 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTGYVFQVWVAWGQGTMVTVSSGGGGSGGGGSGGGGSALETTLTQSPDTLSLSPGERATLSCRASQSVTRGWVAWYQQKPGQAPRLLMYGTSRRATGVPDRFSGSGSGTDFTLTISRLEPEDFAVYYCQQYATSPRTFGQGTRLEIKR

SEQ ID NO: 22 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGASRRATGVPDRFSGSGSGTDFTLTISRLEPEDFAVYYCQQYATSPRTFGQGTRLEIKR

SEQ ID NO: 23 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGKRATLSCRASQSVTRGWVAWYQQKPGQAPRLLMYGASRRATGVPDRFSGSGSGTDFTLTISRLEPEDFAVYYCQQYATSPRTFGQGTRLEIKR

SEQ ID NO: 24 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQVWVAWGQGTMVTVSSGGGGSGGGGSGGGGSALETTLTQSPDTLSLSPGERATLSCRASQSVTRGWVAWYQQKPGQAPRLLMYGASRRATGVPDRFSGSGSGTDFTLTISRLEPEDFAVYYCQQYATSPRTFGQGTRLEIKR

SEQ ID NO: 25 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQVWVAWGQGTMVTVSSGGGGSGGGGSGGGGSALETTLTQSPDTLSLSPGKRATLSCRASQSVTRGWVAWYQQKPGQAPRLLMYGASRRATGVPDRFSGSGSGTDFTLTISRLEPEDFAVYYCQQYATSPRTFGQGTRLEIKR

SEQ ID NO: 26 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTRYVFQYFDHWGQGTMVTVSSGGGGSGGGGSGGGGSALETTLTQSPDTLSLSPGERATLSCRASQSVTRGWVAWYQQKPGQAPRLLMYGASRRATGVPDRFSGSGSGTDFTLTISRLEPEDFAVYYCQQYATSPRTFGQGTRLEIKR

SEQ ID NO: 27 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTRYVFQYFDHWGQGTMVTVSSGGGGSGGGGSGGGGSALETTLTQSPDTLSLSPGKRATLSCRASQSVTRGWVAWYQQKPGQAPRLLMYGASRRATGVPDRFSGSGSGTDFTLTISRLEPEDFAVYYCQQYATSPRTFGQGTRLEIKR

SEQ ID NO: 28 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDILTSYVFQYFDHWGQGTMVTVSSGGGGSGGGGSGGGGSALETTLTQSPDTLSLSPGERATLSCRASQSVTRGWVAWYQQKPGQAPRLLMYGASRRATGVPDRFSGSGSGTDFTLTISRLEPEDFAVYYCQQYATSPRTFGQGTRLEIKR

SEQ ID NO: 29 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDILTSYVFQYFDHWGQGTMVTVSSGGGGSGGGGSGGGGSALETTLTQSPDTLSLSPGKRATLSCRASQSVTRGWVAWYQQKPGQAPRLLMYGASRRATGVPDRFSGSGSGTDFTLTISRLEPEDFAVYYCQQYATSPRTFGQGTRLEIKR

SEQ ID NO: 30 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDILTRYVFQYFDHWGQGTMVTVSSGGGGSGGGGSGGGGSALETTLTQSPDTLSLSPGERATLSCRASQSVTRGWVAWYQQKPGQAPRLLMYGASRRATGVPDRFSGSGSGTDFTLTISRLEPEDFAVYYCQQYATSPRTFGQGTRLEIKR

SEQ ID NO: 31 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDILTRYVFQYFDHWGQGTMVTVSSGGGGSGGGGSGGGGSALETTLTQSPDTLSLSPGKRATLSCRASQSVTRGWVAWYQQKPGQAPRLLMYGASRRATGVPDRFSGSGSGTDFTLTISRLEPEDFAVYYCQQYATSPRTFGQGTRLEIKR

SEQ ID NO: 32 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDILTRYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 33 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDILTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSGSGTDFTLTISRLEPEDFAVYYCQQYATSPRTFGQGTRLEIKR

SEQ ID NO: 34 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTRYVFQYFDHWGQGTMVTVSSGGGGSGGGGSGGGGSALETTLTQSPDTLSLSPGKRATLSCRASQSVTRGWVAWYQQKPGQAPRLLMYGTSRRATGVPDRFSGSGSGTDFTLTISRLEPEDFAVYYCQQYATSPRTFGQGTRLEIKR

SEQ ID NO: 35 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDILTSYVFQYFDHWGQGTMVTVSSGGGGSGGGGSGGGGSALETTLTQSPDTLSLSPGKRATLSCRASQSVTRGWVAWYQQKPGQAPRLLMYGTSRRATGVPDRFSGSGSGTDFTLTISRLEPEDFAVYYCQQYATSPRTFGQGTRLEIKR

SEQ ID NO: 36 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDILTRYVFQYFDHWGQGTMVTVSSGGGGSGGGGSGGGGSALETTLTQSPDTLSLSPGKRATLSCRASQSVTRGWVAWYQQKPGQAPRLLMYGTSRRATGVPDRFSGSGSGTDFTLTISRLEPEDFAVYYCQQYATSPRTFGQGTRLEIKR

SEQ ID NO: 37 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGKRATLSCRASQSVTRGWVAWYQQKPGQAPRLLMYGTSRRATGVPDRFSGSGSGTDFTLTISRLEPEDFAVYYCQQYATSPRTFGQGTRLEIKR

SEQ ID NO: 38 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVLGYYLSWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 39 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGASRRATGVPDRFSGSESGTDFTLTISRLEPEDFAVYYCQQYATSPRTFGQGTRLEIKR

SEQ ID NO: 40 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQVWVAWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 41 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDILTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 42 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSKSGTDFTLTISRLEPEDFAVYYCQQYATSPRTFGQGTRLEIKR

SEQ ID NO: 43 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSGSGTDFTLTISRLEPEDFAVYYCQQYATSPRTFGQGTRLEIKR

SEQ ID NO: 44 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGKRATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 45 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTRYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 46 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTGYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 47 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVLPRVIPWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 48 - protein, 250 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVCRPHFWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 49 - protein, 250 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVRCPYVWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAMYYCQQYATSPRTFGQGTRLEIKR

SEQ ID NO: 50 - protein, 250 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFRPDLWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 51 - protein, 250 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVKSMPTWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 52 - protein, 250 aa, Homo sapiens
QVQLVQSGVEVKKPGAPVKVSCKASGYTFSNHGISWVRQAPGQGLEWVGWISGHDDSTKYAQKFQGRVTMTADTSTSTAYTELRSLKSDDTAVYYCARPFYDTLTSYVPFLYCWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 53 - protein, 250 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVPVPSTWGQGTMVTVSSGGGGSGGGGSGGGGSALETTLTQSPDALSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 54 - protein, 250 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVGIHGLWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 55 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVPCSPPRWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 56 - protein, 250 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVCYPPAWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 57 - protein, 250 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVLPLLSWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 58 - protein, 250 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVALYRLWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 59 - protein, 250 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVRASFSWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 60 - protein, 250 aa, Homo sapiens
QVQLVQSGVEVKKPGASVKVSCKASGYTFSNHGISWVRQAPGQGLEWVGWISGHDDSTKCAQKFQGRVTMTADTSTSTAYIELRSLKSDDTAVYYCARPFYDTLTSYVCTPVPWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAAYYCQQYATSPRTFGQGTRLEIKR

SEQ ID NO: 61 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVWPSFFSWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 62 - protein, 250 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVTPRGYWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 63 - protein, 250 aa, Homo sapiens
QVQLVQSVVEVRKPGASVKVSCKASGYTFSNHGISWVRQAPGQGLEWVGWISGHDDSTKYAQKFQGRVTMTADTSTSTAYIELRSLKSDDTAVYYCARPFYDTLTSYVSSLLSWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 64 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVPLLPLCWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 65 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVPPPSFLWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 66 - protein, 250 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVPTSTTWGQGTMVTVSSGGGGSGGGGSGGGGSALETTLTQSPDTLSLSPGERATLSCRASQSVTRGWVTWYQQKPGQAPRLLMYGTSRRATGVPDRFSGSESGTDFTLTISRLEPEDFAVYYCQQYATSPRTFGQGTRLEIKR

SEQ ID NO: 67 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVISCSWAWGQGTMVTVSSGGGGSGGGGSGGGGSALETTLTQSLDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 68 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVSALPPPWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 69 - protein, 250 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVCRHLFWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 70 - protein, 251 aa, Homo sapiens
QVQLVQSGVEVKKPGASVKVSCKASGYTFSDHGISWVRQAPGQGLEWVGWISGHDDSTKYAQKFQGRVTMTADTSTSTAYIELRSLKSDDTAVYYCARPFYDTLTSYVVSFPSLWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 71 - protein, 251 aa, Homo sapiens
QVQLVQSGVEVKKPGASVKVSCKASGYTFSNHGVSWVRQAPGQGLEWVGWISGHDDSTKYAQKFQGRVTMTADTSTSTAYIELRSLKSDDTAVYYCARPFYDTLTSYVMGVTPSWGQGTMVTVSSGGGGSGGGGSGGGGSALETTLTQSPDTLSLSPGERATLSCRASQSVTRGWVAWYQRKPGQAPRLLMYGTSRRATGVPDRFSGSESGTDFTLTISRLEPEDFAVYYCQQYATSPRTFGQGTRLEIKR

SEQ ID NO: 72 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVLFRPVLWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSSRTFGQGTRLEIKR

SEQ ID NO: 73 - protein, 250 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVPSVGGWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 74 - protein, 250 aa, Homo sapiens
QVQLVQPGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVPPTRHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 75 - protein, 250 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVLRSRDWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 76 - protein, 250 aa, Homo sapiens
QVQLVQSGVEVKKPGASVKVSCKASGYTFSNHGISRVRQAPGQGLEWVGWISGHDDSTKYAQKFQGRVTMTADTSTSTAYIELRSLKSDDTAVYYCARPFYDTLTSYVPLLPPWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 77 - protein, 250 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVLRCVLWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 78 - protein, 250 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVHPSRSWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 79 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVLRLPPQWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 80 - protein, 250 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVGPYGTWGQGTMVTVSSGGGGSGGGGSGGGGSALETTLTQSPDTLSLSPGERATLSCRASQSVTRGWVAWYQQKPGQAPRLLMYGTSRRATGVPDRFSGSKSGTDFTLTISRLEPEDFAVYYCQQYATSPRTFGQGTRLEIKR

SEQ ID NO: 81 - protein, 250 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVTTPCTWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 82 - protein, 244 aa, Homo sapiens
QVQLVESGGGLVQPGRSLRLSCAASGFTFDDYAMHWVRQAPGKGLDWVSAITWNSGHIDYADSVEGRFAVSRDNAKNALYLQMNSLRPEDTAVYYCTKASYLSTSSSLDNWGQGTLVTVSSGGGGSGGGGSGGGGSDIQMTQSPSSLSASIGDRVTITCRASQGIRNYLAWYQQKPGKAPKLLIYAASTLQSGVPSRFSGSGSGTDFTLTISSLQPEDVATYYCQKYNSAPYAFGQGTKVEIKR

SEQ ID NO: 83 - protein, 251 aa, Homo sapiens
QVQLVQSGVEVKKPGASVKVSCKASGYTFSDHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSETGTDFTLTISRLEPEDFAVYYCQQYATSPRTFGQGTRLEIKR

SEQ ID NO: 84 - protein, 251 aa, Homo sapiens
QVQLVQSGVEVKKPGASVKVSCKASGYTFSNHGISWVRQAPGQGLEWVGWISGHGDSTKYAQKFQGRVTMTADTSTSTAYIELRSLKSDDTAVYYCARPFYDTLTSYVIPFLPLWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 85 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVLHIYPHWGQGTMVTVSSGGGGSGGGGSGGGGSALETTLTQSPDTLSLSPGERATLSCRASQSVTRGWVAWYQQKPGQAPRLLMYGTSRRATGVPDRFSGSGSGTDFTLTISRLEPEDFAVYYCQQYATSPRTFGQGTRLEIKR

SEQ ID NO: 86 - protein, 251 aa, Homo sapiens
QVQLVQSGVEVKKPGASVKVSCKVSGYTFSNHGISWVRQAPGQGLEWVGWISGHDDSTKYAQKFQGRVTMTADTSTSTAYIELRSLKSDDTAVYYCARPFYDTLTNYVFEYYASWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 87 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVILYYLHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 88 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPPTFGQGTRLEIKR

SEQ ID NO: 89 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVLMYFPHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 90 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVLFFYPLWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 91 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLVIRR

SEQ ID NO: 92 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFDYYASWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 93 - protein, 251 aa, Homo sapiens
QVQLVQSGVEVKKPGASVKVSCKASGYTFSNHGISWVRQAPGQGLEWVGWISGHGDSTKYAQKFQGRVTMTADTSTSTAYIELRSLKSDDTAVYYCARPFYDTLTSYVIPFLPLWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEISR

SEQ ID NO: 94 - protein, 251 aa, Homo sapiens
QVQLVQSGVEVKKPGASVKVSCKASGYTFSNHSISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 95 - protein, 251 aa, Homo sapiens
QVQLVQSGVEVKKPGASVKVSCKVSGYTFSNHGISWVRQAPGQGLEWVGWISGHDDSTKYAQKFQGRVTMTADTSTSTAYIELRSLKSDDTAVYYCARPFYDTLTSYVFEYYSLWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 96 - protein, 251 aa, Homo sapiens
QVQLVQSGAEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 97 - protein, 251 aa, Homo sapiens
QVQLVQSGVEVKKPGASVKVSCKASGYAFSNHGISWVRQAPGQGLEWVGWISGHDDSAKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 98 - protein, 251 aa, Homo sapiens
QVQLVQSGVEVKKPGASVKVSCKASGYTFSNHGISWVRQAPGQGLEWVGWISGYDDSTKYAQKFQGRVTMTADTSTSTAYIELRSLKSDDTAVYYCARPFYDTLTSYVLEFYLLWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 99 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGKRATLPCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 100 - protein, 250 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVLPLDSWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 101 - protein, 251 aa, Homo sapiens
QVQLVQSGVEVKKPGASVKVSCKASGYTFSNHGISWVRQAPGQGLEWVGWISGHDDSTEYAQKFQGRVTMTADTSTSTAYIELRSLKSDDTAVYYCARPFYDTLTSYVLYFYPSWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 102 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTNTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 103 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEVKR

SEQ ID NO: 104 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRTTGVPDRFSGSESGTDFTLTISRLEPEDFAVYYCQQYATSPRTFGQGTRLEIKR

SEQ ID NO: 105 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLESDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEVKR

SEQ ID NO: 106 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVLHYYALWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 107 - protein, 250 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVLPPSVWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 108 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTPTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 109 - protein, 251 aa, Homo sapiens
QVQLVQSGVEVKKPGASVKVSCKASGYTFSNHGISWVRQAPGQGLEWVGWISGHDDSTKYARKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 110 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLIYGTSRRATGVPDRFSGSESGTDFTLTISRLEPEDFAVYYCQQYATSPRTFGQGTRLEIKR

SEQ ID NO: 111 - protein, 248 aa, Homo sapiens
LVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 112 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVLHYYLYWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 113 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTIVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 114 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTIVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYDTSPRTFGQGTRLEIKR

SEQ ID NO: 115 - protein, 251 aa, Homo sapiens
QVQLVQSGVEVKKPGASVKVSCKASGYTFSNHGISWVRQAPGQGLEWVGWISGHDDSTKYAQKFQGRVTMTTDTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 116 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLAISRLEPEDFAVYYCQQYATSPRTFGQGTRLEIKR

SEQ ID NO: 117 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWDQGTMVTVSSGGGGSGGGGSGGGGSALETTLTQSPDTLSLSPGERATLSCRASQSVTRGWVAWYQQKPGQARRLLMYGTSRRAAGVPDRFSGSESGTDFTLTISRLEPEDCAVYYCQQYATSPRTFGQGTRLEIKR

SEQ ID NO: 118 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDSAVYYCQQYATSPRTFGQGTRLEIKR

SEQ ID NO: 119 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEINR

SEQ ID NO: 120 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTVFTLTISRLEPEDFAVYYCQQYATSPRTFGQGTRLEIKR

SEQ ID NO: 121 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFHYYPLWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 122 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFPVYYLWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 123 - protein, 251 aa, Homo sapiens
QVQLVQSGVEVKKPGASVKVSCKASGYTFSNHGISWVRQAPGQGLEWVGWISGHGDSTKYAQKFQGRVTMTADTSTSTAYIELRSLKSDDTAVYYCARPFYDTLTSYVLHFIDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 124 - protein, 251 aa, Homo sapiens
QVQLVQSGVEVKKPGASVKVPCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 125 - protein, 251 aa, Homo sapiens
QVQLVQSGVEVKKPGASVKVPCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQCPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 126 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAHRLLMYGTSRRATGVPDRFSDSESGTDFTLTISRLEPEDFAVYYCQQYATSPRTFGQGTRLEIKR

SEQ ID NO: 127 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFHYYDVWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 128 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALGTTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 129 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVHEFFSLWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 130 - protein, 251 aa, Homo sapiens
QVQLVQSGVEVKKPGASVKVSCKASGYTFSNHGISWVRQASGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 131 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALKTTLTQSPDTLSLSPGERATLSCRASQSVTRGWVAWYQQKPGQAPRLLMYGTSRRATGVPDRFGGSESGTDFTLTISRLEPEDFAVYYCQQYATSPRTFGQGTRLEIKR

SEQ ID NO: 132 - protein, 251 aa, Homo sapiens
QVQLVQSGVEVKKPGASVKVSCKASGYTFSNHGISWVRQAPGQGLEWVGWISGRDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 133 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASRSVTRGWVAWYQQKPGQAPRLLMYGTSRRAAGVPDRFSGSESGTDFTLTISRLEPEDFAVYYCQQYATSPRTFGQGTRLEIKR

SEQ ID NO: 134 - protein, 251 aa, Homo sapiens
QVQLVQSGVEVKKPGTSVKVSCKASGYTFSNHGISWVRQAPGQGLEWVGWISGHDGSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCKASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 135 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKPDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 136 - protein, 251 aa, Homo sapiens
QVQLVQSGVEVKKPGASVKVSCKASGYTFSDHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 137 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRAAGVPDRFSGSESGTDFTLTISRLEPEDFAVYYCQQYATSPRTFGQGTRLEIKR

SEQ ID NO: 138 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPAQAPRLLMYGTSRRATGVPNRFSDSESGTDFTLTISRLEPEDYAVYYCQQYATSPRTFGQGTRLEIKR

SEQ ID NO: 139 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIRR

SEQ ID NO: 140 - protein, 250 aa, Homo sapiens
QVQLVQSGVEVKRPGASVKVSCKASGYTFSNHGISWVRQAPGQGLEWVGWISGHDDSTKYAQKFQGRVTMTADTSTSTAYIELRSLKSDDTAVYYCARPFYDTLTSYVLALDLWGQGTMVNVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 141 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFGYYSLWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLIISRLEPEDFAVYYCQQYATSPRTFGQGTRLEIKR

SEQ ID NO: 142 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISGLEPEDFAVYYCQQYATSPRTFGQGTRLEIKR

SEQ ID NO: 143 - protein, 251 aa, Homo sapiens
QVQLVQSGAEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVLKYYTDWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 144 - protein, 251 aa, Homo sapiens
QVQLVQSGVEARKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 145 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVMHAYPLWGQGTMVTVSSGGGGSGGGGSGGGGSALETTLTQSPDTLSLSPGERATLSCRASQSVTRGWVAWYQQKSGQAPRLLMYGTSRRATGVPDRFSGSESGTDFTLTISRLEPEDFAVYYCQQYATSPQTFGQGTRLEIKR

SEQ ID NO: 146 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFHYLPVWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 147 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLPCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 148 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHCGQGTMVTVSSGGGGSGGGGSGGGGSALETTLTQSPDTLSLSPEERATLSCRTSQSVTRGWVAWYQQKPDQAPRLLIYGTSRRATGVPDRFSDSESGTDFTLTISRLEPEDFAVYYCQQYATSPRTFGQGTRLEIKR

SEQ ID NO: 149 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYAFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 150 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFEYFSVWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 151 - protein, 251 aa, Homo sapiens
QVQLVQSGVEVKKPGASVKVSCKASGYTFSNHGISCVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 152 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVLFYYPLWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 153 - protein, 251 aa, Homo sapiens
QVQLVQPGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 154 - protein, 251 aa, Homo sapiens
QVQLVQSGVEVKKPGASVKVSCKASGYTFSNHGISWVRQAPGQGLEWVGWISGRDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPAQAPRLLMYGTSRRATGVPNRFSGSESGTDFTLTISRLEPEDFAVYYCQQYATSPRTFGQGTRLEIKR

SEQ ID NO: 155 - protein, 251 aa, Homo sapiens
QVQLVQSGVEVKKPGASVKVSCKASGYTFSNHGISWVRQAPGQGLEWVGWISGHDDSTKHAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 156 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWVQGTMVTVSSGGGGSGGGGSGGGGSALETTLTQSPDTLSLSPGERATLSCRASQSVTRGWVAWYQQKPGQAPRLLMYGTSRRATGVPDRFSDSESGTDFTLTISRLEPEDFAVYYCQQYATSPRTFGQGTRLEIRR

SEQ ID NO: 157 - protein, 251 aa, Homo sapiens
QIQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSDSESGTDFTLTISRLEPEDFAVYYCQQYATSPRTFGQGTRLEIKR

SEQ ID NO: 158 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGRGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 159 - protein, 251 aa, Homo sapiens
QVQLVQSGVEVKKPGASVKVSCKASGYTFFNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 160 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVLAYYPDWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 161 - protein, 251 aa, Homo sapiens
QVQLVQSGVEVKKPGASVKVSCKASGYTFSNHGISWVRQAPGQGLEWVGWISGHDDSTKYAQKFQGRVTITADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 162 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSDSESGTDFTLTISRLEPEDFAVYYCQQYATSPRTFGQGTRLEIKR

SEQ ID NO: 163 - protein, 251 aa, Homo sapiens
QVQLVQSGVEEKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQGVTRGWVAWYQQKPGQAPRLLMYGTSRRATGVPDRFSGSESGTDFTLTISRLEPEDFAVYYCQQYATSPRTFGQGTRLEIKR

SEQ ID NO: 164 - protein, 244 aa, Homo sapiens
QVQLVESGGGLVQPGRSLRLSCAASGFTFDDYAMHWVRQAPGKGLDWVSAITWNSGHIDYADSVEGRFAVSRDNAKNALYLQMNSLRPEDTAVYYCTKASYLSTSSSLDNWGQGTLVTVSSGGGGSGGGGSGGGGSDIQMTQSPSSLSASIGDRVTITCRASQGIRNYLAWYQQKPGKAPKLLIYAASTLQSGVPSRFSGSGSGTDFTLTISSLQPEDVATYYCQKYNSAPYAFGQGTKVEIER

SEQ ID NO: 165 - protein, 251 aa, Homo sapiens
QVQLVQSGVKVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVLPVYDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 166 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFAHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 167 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCGASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 168 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPNTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 169 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDLAVYYCQQYATSPRTFGQGTRLEIKR

SEQ ID NO: 170 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVIFYYPTWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 171 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTTVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 172 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVLEVYHPWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 173 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFAPLVTWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 174 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVLHAYAFWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 175 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTGYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAHRLLMYGTSRRAAGVPDRFSGSESGTDFTLTISRLEPEDFAVYYCQQYATSPRTFGQGTRLEIKR

SEQ ID NO: 176 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVILYYLHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPQTFGQGTRLEIKR

SEQ ID NO: 177 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFEFLPLWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 178 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVRPFYAHWGQGTMVTVSSGGGGSGGGGSGGGGSALETTLTQSPDTLSLSPGERATLSCRASQSVTRGWVAWYQQKPGQAPRLLMYGTSRRATGVPDRFSGSGSGTDFTLTISRLEPEDFAVYYCQQYATSPRTFGQGTRLEIKR

SEQ ID NO: 179 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQGVTRGWVAWYQQKPGQAPRLLMYGTSRRATGVPDRFSGSESGTDFTLTISRLEPEDFAVYYCQQYATSPRTFGQGTRLEIKR

SEQ ID NO: 180 - protein, 251 aa, Homo sapiens
QAQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVLHFYRVWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 181 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSVLETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 182 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVIQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 183 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTGYIELRSLKSDDTAVYYCARPFYDTLTSYVHEFFSLWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 184 - protein, 251 aa, Homo sapiens
QVQLVQSGVEVKKPGASVKVSCKASGYTFSNHGISWVRQAPGRGLEWVGWISGHDDSTKYAQKFQGRVTMTADTSTSTAYIELRSLKSDDTAVYYCARPFYDTLTSYVMQFFPTWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 185 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVLSFYPVWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 186 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVLYYYAFWGQGTMVTVSSGGGGSGGGGSGGGGSALETTLTQSPDTLSLSPGERATLSCRASQSVTRGWVAWYQQKPGQALRLLMYGTSRRAAGVPDRFSDSESGTDFTLTISRLEPEDCAVYYCQQYATSPRTFGQGTRLEIKR

SEQ ID NO: 187 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQSHRLLMYGTFRRPSGVPDRFSDSESGTDFSLTISRLEPEDSAVYYCQQYATSPRTFGQGTRLEIKR

SEQ ID NO: 188 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTDVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 189 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELKSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 190 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVLHFYPLWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 191 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVLQYYVLWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 192 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLELEDFAVYYCQQYATSPRAFGQGTRLEIKR

SEQ ID NO: 193 - protein, 251 aa, Homo sapiens
QVQLVQSGVEVKKPGASVKISCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLVYGTSRRATGVPDRFSGSESGTDFTLTISRLEPEDFAVYYCQQYATSPRTFGQGTRLEIKR

SEQ ID NO: 194 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTVYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 195 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDYWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 196 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVLPVWVSWGQGTMVTVSSGGGGSGGGGSGGGGSALETTLTQSPDTLSLSPGERATLSCRASQSVTRGWVAWYQQKPDQASRLLMYGTSRRATGVPDRFSGSESGTDFTLTISRLEPEDSAVYYCQQYATSPRTFGQGTRLEIKR

SEQ ID NO: 197 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRTTGVPGRFSGSESGTDFTLTISRLEPEDFAVYYCQQYATSPRTFGQGTRLEIKR

SEQ ID NO: 198 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRGLKSDDTAVYYCARPFYDTLTSYVFQYFDHWGQGTMVTVPSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 199 - protein, 251 aa, Homo sapiens
QVQLVQSGVEVKKPGASVKVYCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 200 - protein, 251 aa, Homo sapiens
QVQLVQSGVEVKKPGASVKVSCKASGYTFSNHGISWVRQAPGQGLEWVGWVSGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 201 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVIEYYPVWGQGTMVTVSSGGGGSGGGGSGGGGSALETTLTQSPDTLSLSPGERATLSCRASQSVTRGWVAWYQQKPGQAPRLLMYGTSRRTTGVPDRFSGSESGTDFTLSISRLEPEDFAVYYCQQYVTSPRTFGQGTRLEIKR

SEQ ID NO: 202 - protein, 251 aa, Homo sapiens
QVQLVQSGVEAKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLPLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 203 - protein, 251 aa, Homo sapiens
QVQLVQSGVEVKKPGASVKVSCKASGYTFSNHGISWVRQAPGQGLEWVGWISGHDDSTEYAQKFQGRVTMTADTSTSTAYIELRSLKSDDTAVYYCARPFYDTLTSYVLHYLPLWGQGTMVTVSSGGGGSGGGGSGGGGSALETTLTQSPDTLSLSPGERAALSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 204 - protein, 251 aa, Homo sapiens
QVQLVQSGVGVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 205 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGEGATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 206 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKPDDTAVYYCARPFYDTLTSYVFHFYPVWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 207 - protein, 251 aa, Homo sapiens
QVQLVQSGVEVKKPGASVKVSCKASGYTFSNHGISWVRQAPGQGLEWVGWISGHDDSTKYAQKFQGRVTMAADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 208 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVLEAFSLWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYVTSPRTFGQGTRLEIKR

SEQ ID NO: 209 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFGFYPFWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTGFTLTISRLEPEDFAVYYCQQYATSPRTFGQGTRLEIKR

SEQ ID NO: 210 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSITRGWVAWYQQKPGQASRLLMYGSSRRAAGVPDRFSGSESGTDFTLTISRLEPEDSAVYCCQQYATSPRTFGQGTRLEIKR

SEQ ID NO: 211 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPIYDTLTSYVFQYFDHWGQGTMVTVPSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 212 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVLWYYQDWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 213 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVIPFYPLWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 214 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERAALSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 215 - protein, 251 aa, Homo sapiens
QVQLVQSEVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 216 - protein, 251 aa, Homo sapiens
QVQLVQSGAEVKKPGASVKVSCKASGYTFSNHSISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 217 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVLEYFPLWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 218 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVLEFFPAWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 219 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVIEYLPLWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 220 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVLHYYSAWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 221 - protein, 251 aa, Homo sapiens
QVQLVQSGVEVRKPGASVKVSCKASGYTFSNHGISWVRQAPGQGLEWVGWISGHDDSTKYAQKFQGRVTMTADTSTSTAYIELRSLKSDDTAVYYCARPFYDTLTSYVLFYYTAWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 222 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVLHYLPVWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 223 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDALSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 224 - protein, 251 aa, Homo sapiens
QVQLVQSGVEVKKPGASVKVSCKASGYTFSNYGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 225 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVMHYYPTWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 226 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVLSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 227 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVLQYFRYWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 228 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVLQVFDTWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 229 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRVSQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 230 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGAMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 231 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVLDYYSSWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 232 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDALTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 233 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASRSVTRGWVAWYQQKPGQAPRLLMYGTSRRATGVPDRFSGSESGTDFTLTISRLEPEDFAVYYCQQYATSPRTFGQGTRLEIKR

SEQ ID NO: 234 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFPFYPHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 235 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVIGFYPVWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 236 - protein, 251 aa, Homo sapiens
QVQLVQSGVEVKKPGASVKVSCKASGYTFSSHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 237 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVMDFYSVWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 238 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVIVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 239 - protein, 251 aa, Homo sapiens
QVQLVQSGVEVKKPGASVKISCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 240 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVLPFYALWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPPTFGQGTRLEIKR

SEQ ID NO: 241 - protein, 251 aa, Homo sapiens
QVQLVQAAVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 242 - protein, 251 aa, Homo sapiens
QVQLVQSGVEVKKPGASVKVSCKASGYTFSNHGISWVRQAPGQGLEWVGWISGHDDSTKYAQKFQGRVTMTADTSASTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 243 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSGDTAVYYCARPFYDTLTSYVFQYFDHWGQGTMVTVSSGGGGSGGGGSGGGGSALETTLTQSSDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 244 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVLPYLTHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 245 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSNGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 246 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSNGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEVKR

SEQ ID NO: 247 - protein, 251 aa, Homo sapiens
QVQLVQSGVEVKKPGASVKVSCEASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 248 - protein, 251 aa, Homo sapiens
QVQLVQSVVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 249 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRANQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 250 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRAWVAWYQQKPGQAPRLLMYGTSRRATGVPDRFSGSESGTDFTLTISRLEPEDFAVYYCQQYATSPRTFGQGTRLEIKR

SEQ ID NO: 251 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVLGFYPVWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 252 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVLHYHTHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 253 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRDWVAWYQQKPGQAPRLLMYGTSRRAAGVPDRFSGSESGTDFTLTISRLEPEDFAVYYCQQYATSPRTFGQGTRLEIKR

SEQ ID NO: 254 - protein, 251 aa, Homo sapiens
QVQLVQSGVEVNKPGASVKGSCKAYGYTFSNHGISWVRQAPGQGLEWVGWINDHDDSTKYAQKFQGRVTMTADTYTSTAYIELRSLKSDDTAVYYCARPFYDTLTSYVIHFLPLWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 255 - protein, 251 aa, Homo sapiens
QVQLVQSAVEVKKPGASVKVSCKASGYTFSNHGISWVRQAPGQGLEWVGWISGHGDSTKYAQKFQGRVTMTADTSTSTAYIELRSLKSDDTAVYYCARPFYDTLTSYVIPFLPLWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 256 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETALTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 257 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTINRLEPEDFAVYYCQQYATSPRTFGQGTRLEIKR

SEQ ID NO: 258 - protein, 251 aa, Homo sapiens
QVQLVQSGVEVKKPGASVKVSCKASGYTFSNHGISWVRQAPGQELEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQRPGQAPRLLMYGTSRRATGVPDRFSGSESGTDFTLTISRLEPEDFAVYYCQQYATSPRTFGQGTRLEIKR

SEQ ID NO: 259 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVMHYLPVWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 260 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVLEFFSHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 261 - protein, 244 aa, Homo sapiens
QVQLAESGGGLVQPGRSLRLSCAGSGFTFDDYAMHWVRQAPGKGLDWVSAITWNSGHIDYADSVEGRFAVSRDNAKNALYLQMNSLRPEDTAVYYCTKASYLSTSSSLDNWGQGTLVTVSSGGGGSGGGGSGGGGSDIQMTQSPSSLSASIGDRVTITCRASQGIRNYLAWYQQKPGKAPKLLIYAASTLQSGVPSRFSGSGSGTDFTLTISSLQPEDVATYYCQKYNSAPYAFGQGTKVEIKR

SEQ ID NO: 262 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVIHYLVTWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 263 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVLPYYTLWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 264 - protein, 251 aa, Homo sapiens
QVQLVQSGVEVKKPGASVKVSCKASGYTFSNHGISWVRQAPGQGLEWVGWISGHDDSTKYAQKFQGRVTMTTDTSTSTAYIELRSLKSDDTAVYYCARPFYDTLTSYVLHYYPIWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 265 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVLWFYPLWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 266 - protein, 251 aa, Homo sapiens
QVQLVQSGVEVKKPGASVKVSCKASGYTFSNHGISWVRQAPGQGLEWVGWISGHDDSTKYAQKFQGRVTMTADASTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYGTSPRTFGQGTRLEIKR

SEQ ID NO: 267 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYRQKPGQAPRLLMYGTSRRATGVPDRFSGSESGTDFTLTISRLEPEDFAVYYCQQYATSPRTFGQGTRLEIKR

SEQ ID NO: 268 - protein, 251 aa, Homo sapiens
QVQLVQSGVEVKKPGASVKVSCKASGYTFSNHGISWVRQAPGQGLEWVGWISGHDDSTKYAQKFQGRVTMTADTSMSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWIAWYQQKPGQAPRLLMYGTSRRATGVPDRFSGSESGTDFTLTISRLEPEDFAVYYCQQYATSPRTFGQGTRLEIKR

SEQ ID NO: 269 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVLHYYTHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 270 - protein, 251 aa, Homo sapiens
QVQLVQSGVEVKKPGASVKVSCKASGYTFSNHGISWVRQAPGQGLEWVGWVSGHDDSTKYAQKFQGRVTMTADTSTSTAYIELRSLKSDDTAVYYCARPFYDTLTSYVLHYYAYWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 271 - protein, 251 aa, Homo sapiens
QVQLVQSGVEVKKPGASVKVSCKASGYTFSNHGISWVRQAPGQGLEWVGWISGHDDSTRYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 272 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVIHFYSLWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 273 - protein, 251 aa, Homo sapiens
QVQLVQSGVEVKKPGASVKVSCKASGYTFSNHGISWVRQAPGQGLEWVGWISGHGDSTKYAQKFQGRVTMTADTSTSTAYIELRSLKSDDTAVYYCARPFYDTLTSYVFGFFPHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 274 - protein, 251 aa, Homo sapiens
QVQLVQSGVEVKMPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 275 - protein, 251 aa, Homo sapiens
QVQLVQSGVEVKKPGASVKVSCKASGYTFSNHGISWVRQAPGQGLEWVGWISGHDDSTKYAQKFQGRVAMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 276 - protein, 251 aa, Homo sapiens
QVQLVQSGVEVKKPGASVKVSCKASGYTFSNHGISWVRQAPGQGLEWVGWISGHDDSTKYAQKFQGRATMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 277 - protein, 251 aa, Homo sapiens
QVQLVQSGVEVKKPGASVKVSCKASGYTFSNHGISWVRQAPGQGLEWVGWISGHDDSTKYAQKFQGRVTMTADISTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 278 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRAGQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 279 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFAHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESRTDFTLTISRLEPEDFAVYYCQQYDTSPRTFGQGTRLEIKR

SEQ ID NO: 280 - protein, 244 aa, Homo sapiens
QVQLVESGGGLVQPGRSLRLSCAASGFTFDDYAMHWVRQAPGKGLDWVSAITWNSGHIDYADSVEGRFAVSRDNAKNALYLQMNSLRPEDTAVYYCTKASYLSTSSSLDNWGQGTLVTVSSGGGGSGGGGSGGGGSDIQMTQSPSSLSASIGDRVTITCRASQGIRNYLAWYQQKPGKAPKLLIYAASTLQSGVPSRFSGSGSGTDFTLTISSLQPEDVAAYYCQKYNSAPYAFGQGTKVEIKR

SEQ ID NO: 281 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPKDFAVYYCQQYATSPRTFGQGTRLEIKR

SEQ ID NO: 282 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQASRLLMYGTSRRATGVPDRFSGSKSGTDFTLTISRLEPEDFAVYYCQQYATSPRTFGQGTRLEIKR

SEQ ID NO: 283 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVLDFYSVWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 284 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPIYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGGESGTDFTLTISRLEPEDFAVYYCQQYATSPRTFGQGTRLEIKR

SEQ ID NO: 285 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVLYYYAFWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPQTFGQGTRLEIKR

SEQ ID NO: 286 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVADRFSDSESGTDFTLTISRLEPEDFAVYYCQQYATSPRTFGQGTRLEIKR

SEQ ID NO: 287 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFFFYPFWGQGTMVTVSSGGGGSGGGGSGGGGSALETTLTQSPDTLSLSPGERATLSCRAGQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 288 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATDVPDRFSGSESGTDFTLTISRLEPEDFAVYYCQQYATSPRTFGQGTRLEIKR

SEQ ID NO: 289 - protein, 251 aa, Homo sapiens
QVQLVQSGVEAKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 290 - protein, 251 aa, Homo sapiens
QVQLVQSGVEVKKPGASVKVFCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 291 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGLGTRLEIKR

SEQ ID NO: 292 - protein, 251 aa, Homo sapiens
QVQLVQSGVEVKKPGASVKVSCKASGYTFSNHGISWVRQAPGQGLEWVVWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 293 - protein, 251 aa, Homo sapiens
QVQLVQSGVEVKKPGASVKVSCKASGYTFSNHGISWVRQAPGQGLEWVGWVSGHDDSTKYAQKFQGRVTMTADTSTSTAYIELRSLKSDDTAVYYCARPFYDTLTSYVIPFLTHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 294 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVLEFFPDWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 295 - protein, 251 aa, Homo sapiens
QVQLAQSGVEVKKPGASVKVSCKASGYTFSNYGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 296 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDRWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 297 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLESDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 298 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSITRGWVAWYQQKPGQAPRLLMYGTSRRATGVPDRFSGSESGTDFTLTISRLEPEDFAVYYCQQYATSPRTFGQGTRLEIKR

SEQ ID NO: 299 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSGDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 300 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLTLSPGERATLSCRASQSVTRGWVAWYQQKPGQAPRLLMYGTSRRATGVPDRFSGSESGTDFTLTISRLEPEDFAVYYCQQYATSPRTFGQGARLEIKR

SEQ ID NO: 301 - protein, 251 aa, Homo sapiens
QIQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 302 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWIAWYQQKPGQAPRLLMYGTSRRATGVPDRFSGSESGTDFTLTISRLEPEDFAVYYCQQYATSPRTFGQGTRLEIKR

SEQ ID NO: 303 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISKLEPEDFAVYYCQQYATSPRTFGQGTRLEIKR

SEQ ID NO: 304 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVLHYYAHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 305 - protein, 251 aa, Homo sapiens
HVQLVLSGVEVKKPGASVKVSCKASGYTFSNHGISWVRQAPGQGLEWVGWISGRDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 306 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCVRPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 307 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTVSRLEPEDFAVYYCQQYATSPRTFGQGTRLEIKR

SEQ ID NO: 308 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRSWVAWYQQKPGQAPRLLMYGTSRRATGVPDRFSGSESGTDFTLTISRLEPEDFAVYYCQQYATSPRTFGQGTRLEIKR

SEQ ID NO: 309 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSGLETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 310 - protein, 251 aa, Homo sapiens
QVQLVQAGVEVKKPGASVKVSCKASGYTFSNHGISWVRQAPGQELEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQRPGQAPRLLMYGTSRRATGVPDRFSGSESGTDFTLTISRLEPEDFAVYYCQQYATSPRTFGQGTRLEIKR

SEQ ID NO: 311 - protein, 251 aa, Homo sapiens
QVQLVQAAVEVKKPEASVKVSCKASGYTFSNHGISWVRQAPGQGLEWVGWISDHDDSTKYAQKFQGRVTMTVDTSTSTAYIELRSLKSDDTDAYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSSRTFGQGTRLEIKR

SEQ ID NO: 312 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSAPETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 313 - protein, 251 aa, Homo sapiens
QVQLVQSGVEVKKPGASVKVSCKASGYTFSNHGISWVRQAPGQGLEWMGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 314 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVAYRFSASGSGTDFTLTISRLEPEDFAVYYCQQYSTSPRTFGQGTRLEIKR

SEQ ID NO: 315 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQATRLVMYGTSRRATGVPDRFSGSESGTDFTLTISRLEPEDFAVYYCQQYATSPRTFGQGTRLEIKR

SEQ ID NO: 316 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSTDTLSLSPGERATLSCRASQSVTRGWVAWYQQKPGQASRLLMYGTSRRATGVPDRFSGSESGTDFTLTISRLEPEDYAVYYCQQYDTSPRTFGQGTRLEIKR

SEQ ID NO: 317 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYGTSPRTFGQGTRLEIKR

SEQ ID NO: 318 - protein, 251 aa, Homo sapiens
QVQLIQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 319 - protein, 251 aa, Homo sapiens
  Site (115): Xaa equals any of the naturally occurring L-amino acids
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYGFQYFDHXCQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATSPRTFGQGTRLEIKR

SEQ ID NO: 320 - protein, 251 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTMVTVSSGGGGSGGGGSGGGGSALETTLTQSPDTLSLSPGERATLSCRASQSVTRGWVAWYQQKPGQAPRLLMYGTSRRATGVPDRFSGSESGTDFTLTISRLEPEDFAVYYCQQYATLPRTFGQGTRLEIKR

SEQ ID NO: 321 - protein, 249 aa, Homo sapiens
QVQLQQSGAEVKKPGSSVRVSCKASGGTFNNNAINWVRQAPGQGLEWIGGIIPMFGTATYSQNFQGRVAITADESTSTASMELSSLRSEDTAVYYCARSRDLLLFPHHGLDSWGRGTMVTVSSGGGGSGGGGSGGGGSAFSSELTQDPAVSVALGQTVRVTCQGDSLRSHYASWYQQKPGQAPVLVIYGKNNRPSGIPDRFSGSSSGNTASLTITGAQAEDEADYYCNSRDSSGNHWVFGGGTELTVLG

SEQ ID NO: 322 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHHSFDLWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNYRDSSGNHWVFGGGTELTVLG

SEQ ID NO: 323 - protein, 249 aa, Homo sapiens
QVQLQQSGAEVKKPGSSVRVSCKASGGTFNNDAINWVRQAPGQGLEWMGGIIPMFGTAKYSQNFQGRVAITADESTSTASMELSSLRSEDTAVYYCARSRDLLLFPLAPLYPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 324 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHHGLDVWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 325 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHHSLDLWGRGTMVTVSSGGGGSGGGGSGGGGSAFSSELTQDPAVSVALAQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 326 - protein, 249 aa, Homo sapiens
QVQLQQSGAEVKKPGSSVWVSCKASGGTFNNNAINWVRQAPGQGLEWMGGIIPMFGTAKYSQNFQGRVAITADESTSTASMELSSLRSEDTAVYYCARSRDLLLFPHHSFDLWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 327 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTGTASMELSSLRSEDTAVYYCARSRDLLLFPHHALSPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCSSRDSSGNHWVFGGGTELTVLG

SEQ ID NO: 328 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRYLLLFPHHSFDLWGRGTMVTVSSGGGGSGGGGSGGGGSAFSSELTQDPAVSVPLGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 329 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHHSFDLWGRGTMVTVSSGGGGSGGGGSGGGGSAFSSELTQDPAVSVALGQTVRVTCQGDSLRSYYASWYQQKPGQAPVLVIYGKNNRPSGITDRFSGSSSGNTASLTITGAQAEDEADYYCNSRDSSGNHWVFGGGTELTVLG

SEQ ID NO: 330 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHDHLLFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSNGNHWVFGGGTELTVLG

SEQ ID NO: 331 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPSDPLGFWGRGTMVTVSSGGGGSGGGGSGGGGSAFSSELTQDPAVSVALGQTVRVTCQGDSLRSYYASWYQQKPGQAPVLVIYGKNNRPPGIPDRFSGSSSGNTASLTITGAQAEDEADYYCNSRDSSGNHWVFGGGTELTVLG

SEQ ID NO: 332 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPTHPLSFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 333 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPLAPLFFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 334 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPSDPLSLWSRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 335 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPSAPLSFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 336 - protein, 249 aa, Homo sapiens
QVPLQRSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPASPLSFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 337 - protein, 248 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPNDALSWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEANYYCNSRDSSGNHWVFGGGTELTVLG

SEQ ID NO: 338 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPSAPLRFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 339 - protein, 248 aa, Homo sapiens
QVQLQQSGAEVKKPGSSVRVSCKASGGTFNSNAINWVRQAPGQGLEWMGGIIPMFGTAKYSQNFQGRVAITADESTSTASMELSSLRSEDTAVYYCARSRDLLLFPHDPLEWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 340 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPQSPLYPWGRGTMVTVSSGGGGSGGGGSGGGGSAFSSELTQDPAVSVALGQTVRVTCQGDSLRSYYASWYQQKPGQAPVLVIYGKNNRPSGIPDRFSGYSSGNTASLTISGAQAEDEADYYCNYRDSSGNHWVFGGGTELTVLG

SEQ ID NO: 341 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCAGSRDLLLFPHSSLVFWGRGTMVTVSSGGGGSGGGGSGGGGSASSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 342 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPYDPLLFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 343 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHAPLYFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 344 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHAPLSPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 345 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPLSPLSFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 346 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPDFPMAPWGRGTMVTVSSGGGGSGGGGSGGGGSAFSSELTQDPAVSVALGQTVRVTCQGDSLRSYYASWYQQKPGQAPVLVIYGKNNRPSGIPDRFSGYSSGNTASLTITGAQAEDEADYYCNSRDSSGNHWVFDGGTELTVLG

SEQ ID NO: 347 - protein, 248 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHSPLYWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 348 - protein, 249 aa, Homo sapiens
QVQLQQSGAEVKKPGSSVRVSCKASGGTFSNNAINWVRQAPGQGLEWMGGIIPMFGTAKYSQNFQGRVAITADESTSTASMELSSLRSEDTAVYYCARSRDLLLFPQDPLSPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 349 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPDDPLLSWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 350 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHGPLLIWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 351 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPGSPLLFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNIASLTITGAQAEDEADYYCNSRDSSGNHWVFGGGTELTVLG

SEQ ID NO: 352 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPTAALSFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 353 - protein, 249 aa, Homo sapiens
QVQLQQSGAEVKKPGSSVRVSCKASGGTSNNNAINWVRQAPGQGLEWMGGIIPMFGTAKYSQNFQGRVAITADESTSTASMELSSLRSEDTAVYYCARSRDLLLFPHTPLRFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDESDYYCNSRDSSGTHWVFGGGTELTVLG

SEQ ID NO: 354 - protein, 248 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHSPLTWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 355 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPFSPLLFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 356 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPSHPLFFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 357 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPRPLLLFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 358 - protein, 249 aa, Homo sapiens
QVQLQQSGAEVKKPGSSVRVSCKASGGTFNNDAINWVRQAPGQGLEWMGGIIPMFGTAKYSQNFQGRVAITADESTSTASMELSSLRSEDTAVYYCARSRDLLLFPSQYLDFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 359 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPSSPLLFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 360 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPYFPLVFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 361 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPGSPLLDWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 362 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPQAPLLFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTISGAQAEDEADYYCNSRDSSGNHWVFGGGTELTVLG

SEQ ID NO: 363 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHSYLSPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 364 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPQTPLFPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 365 - protein, 249 aa, Homo sapiens
QVQLQQSGAEVKKPGSSVRVSCKASGGTFNNNAINWVRQAPGQGLEWMGGIIPMFGTAKYSQDFQGRVAITADESTSTASMELSSLRSEDTAVYYCARSRDLLLFPHSPLHPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 366 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHAPLAPWGRGTMVTVSSGGGGSGGGGSGGGGSASSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 367 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHTTLRFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 368 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPYAVLHFWGRGTMVAVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 369 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPTSPLRLWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 370 - protein, 249 aa, Homo sapiens
QVQLQQSGAEVKKPGSSVRVSCKASGGTFNNNAINWVRQAPGQGLEWMGGIIPMFGTAKYSQNFQGRVAIAADESTSTASMELSSLRSEDTAVYYCARSRDLLLFPSDALSFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 371 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPNAPLDPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 372 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHDPPRFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 373 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPSEPLWPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 374 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPSSPLSNWGRGTMVTVSSGGGGSGGGGSGGGGSAFSSELTQDPAVSVALGQTVRVTCQGDSLRSYYASWYQQKPGQAPVLVIYGKNNRPSGIPNRFSGSSSGNTASLTITGAQAEDEADYYCNSRDSSGNHWVFGGGTELTVLG

SEQ ID NO: 375 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHLPLTPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 376 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPRSPLLFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 377 - protein, 249 aa, Homo sapiens
QVQLQQSGAEVKKPGSSVRVSCKASGSTFNNNAINWVRQAPGQGLEWMGGIIPMFGTAKYSQNFQGRVAITADESTSTASMELSSLRSEDTAVYYCARSRDLLLFPTSPLQLWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 378 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPYTPLLFWGRGTMVTVSSGGGGSGGGGSGGGGSAFSSELTQDPAVSVALGQTVRVTCQGDSLRSYYASWYQQKPGQAPVLVIYGKNNRPSGTPDRFSGSSSGNTASLTITGAQAEDEADYYCNSRDSSGNHWVFGGGTELTVLG

SEQ ID NO: 379 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPSSPLAFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 380 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSPRSEDTAVYYCARSRDLLLFPHDPLYFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGDHWVFGGGTELTVLG

SEQ ID NO: 381 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPSAHLLFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 382 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPAGPLRFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 383 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPDHAFFVWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 384 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPSDSGFAWGRGTMVTVSSGGGGSGGGGSGGGGSAFSSELTQDPALSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 385 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPSSYLEFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 386 - protein, 249 aa, Homo sapiens
QVQLQQSGAEVKKPGSSVRVSCKASGGTFNNNAINWVRQAPGQGLEWMGGIIPMFGAAKYSQNFQGRVAITADESTSTASMELSSLRSEDTAVYYCARSRDLLLFPRDPLIIWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 387 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPSAPLHPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 388 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPNAPLLLWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 389 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPAAPLLFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEANYYCNSRDSSGNHWVFGGGTELTVLG

SEQ ID NO: 390 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPSAPLDPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 391 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPNAVLDIWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 392 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPSEPLFFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 393 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPSSVLWPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTKLTVLG

SEQ ID NO: 394 - protein, 248 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHAPLQWGRGTMVTVSSGGGGSGGGGSGGGGSAFSSGLTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 395 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPDSPLAPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 396 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPSSPLHPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 397 - protein, 249 aa, Homo sapiens
EVNLRESGGGVVQPGRSLRLSCAASGFTFSSYGMHWVRQAPGKGLEWVAVISYDGSNKYYADSVKGRFTISRDNSKNTLYLQMNSLRAEDTAVYYCAKDGYYDILTGYSYYGMDVWGQGTMVTVSSGGGGSGGGGSGGGGSSELTQDPAVSVALGQTVRITCQGDSLRSYYTNWFQQKPGQAPLLVVYAKNKRPSGIPDRFSGSSSGNTASLTITGAQAEDEADYYCNSRDSSGNHVVFGGGTKLTVLG

SEQ ID NO: 398 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPSMPLTFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 399 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHSILHPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 400 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHAPLSHWGRRTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 401 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPDAALRFWGRGTMVTVSSGGGGSGGGGSGGGGSAFSSELTQDPAVSVALGQTVRVTCQGDSLRSYYASWYQQKPGQAPVLIIYGKNNRPSGIPDRFSGSSSGNTASLTITGAQAEDEADYYCNSRDSSGNHWVFGGGTELTVLG

SEQ ID NO: 402 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPSSHLSFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 403 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPSAPLSSWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 404 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHAPLTPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 405 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPYDPLHSWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 406 - protein, 249 aa, Homo sapiens
QVQLQQSGAEVKKPGSSVRVSCKASGGTFNNNAINWVRQAPGQGLEWMGGIIPMFGTVKYSQNFQGRVAITADESTSTASMELSSLRSEDTAVYYCARSRDLLLFPHFPLHPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 407 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPAHPLLFWGRRTMVTVSSGGGGSGGGGSGGGGSAFSSELTQDPAVSVALGQTVRVTCQGDSLRSYYASWYQQKPGQAPVLVIYGKNNRPSGIPDRFSGSSSGDTASLTITGAQAEDEADYYCNSRDSSGNHWVFGGGTELTVLG

SEQ ID NO: 408 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPFEPLIIWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 409 - protein, 249 aa, Homo sapiens
QVQLQQSGAEVKKPGSSVRVSCKASGGTFSNNAINWVRQAPGQGLEWMGGIIPMFGTAKYSQNFQGRVAITADESTSTASMELSSLRSEDTAVYYCARSRDLLLFPASPLNPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 410 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPSSPLYFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 411 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPTSPLSFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 412 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPDDGLSSWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 413 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPISPLCFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 414 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPTAPLYGWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 415 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHHSLFFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 416 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPQGPLRFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 417 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPAAPLAFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 418 - protein, 249 aa, Homo sapiens
QVQLQQSGAEVKKPGSSVRVSCKASGGTFNNNAINWVRQAPGQGLEWMGGIIPMFGTVKYSQNFQGRVAITADESTSTASMELSSLRSEDTAVYYCARSRDLLLFPHLPLLFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 419 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPTFPLIFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 420 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPDDPLSFWGRGTMVTVSSGGGGSGGGGSGGGGSAFPSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 421 - protein, 249 aa, Homo sapiens
RVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPTDSLLFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 422 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPSAPLTPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 423 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRYLLLFPYAPLYDWGRGTMVTVSSGGGGSGGGGSGGGGSAFSSELTQDPAVSVALGQTVRVTCQGDSLRSYYASWYQQKPGQAPVLVIYGKNKRPSGIPDRFSGSSSGNTASLTITGAQAEDEADYYCNSRDSSGNHWVFGGGTELTVLG

SEQ ID NO: 424 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHSPLSFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 425 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTGTASMELSSLRSEDTAVYYCARSRDLLLFPTAPLDLWGRGTMVTVSSGGGGSGGGGSGGGGSAFSSELTQDPAVSVALGQTVRVTCQGDSLRSYYASWYQQKPGQAPVLVTYGKNNRPSGIPDRFSGSSSGNTASLTITGAQAEDEADYYCNSRDSSGNHWVFGGGTELTVLG

SEQ ID NO: 426 - protein, 249 aa, Homo sapiens
QVQLQQSGAEVKKPGSSARVSCKASGGTFNNNAINWVRQAPGQGLEWMGGIIPMFGTAKYSQNFQGRVAITADESTSTASMELSSLRSEDTAVYYCARSRDLLLFPHTHLTFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 427 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHSSLDFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 428 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPNHPMFPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 429 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPLSSLEFWGLGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGVGTELTVLG

SEQ ID NO: 430 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPNAPLHPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 431 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPRAHLRFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 432 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPYDPLHFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 433 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHDALQSWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 434 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPRTPLTFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCSSRDSSGNHWVFGGGTELTVLG

SEQ ID NO: 435 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPAAHLSFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 436 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPRAPLLFWGRGTMVTVSSGGGGSGGGGSGGGGSAFSSELTQDPAVSVALGRTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 437 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPFSPLAPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 438 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPRAPLDFWGRGTMVTVSSGGGGSGGGGSGGGGSAFSSELTQDPAVSVALGQTVRVTCQGDSLRSYYASWYQQKPGQAPVLVTYGKNNRPSGIPDRFSGSSSGNTASLTITGAQAEDEADYYCNSRDSSGNHWVFGGGTELTVLG

SEQ ID NO: 439 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPTAPLRFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 440 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPSSPLRIWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELNVLG

SEQ ID NO: 441 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPTEPLQFWGRGTMVTVSSGGGGSGGGGSGGGGSAFSSELTQDPAVSVALGQTVRVTCQGDSLRSYYASWYQQKPGQAPVLVIYGKNNRPSGTPDRFSGSSSGNTASLTITGAQAEDEADYYCNSRDSSGNHWVFGGGTELTVLG

SEQ ID NO: 442 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPSDPLSAWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 443 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPYNPPIFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 444 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHTPLLFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 445 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHAPLDLWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 446 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPFDPLLIWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 447 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPTDALRIWGRGTMVTVSSGGGGSGGGGSGGGGSAFSSELTQDPAVSVALGQTVRVTCQGDSLRSHYASWYQQKPGQAPVLVIYGKNNRPSGIPDRFSGSSSGNTASLTITGAQAEDEADYYCNSRDSSGNHWVFGGGTELTVLG

SEQ ID NO: 448 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPAAPLTPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 449 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPEGPLLFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 450 - protein, 249 aa, Homo sapiens
QVQLQQPGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPYAPLSFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 451 - protein, 249 aa, Homo sapiens
HVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPADSLSFWGRGTMVTVSSGGGGSGGGGSGGGGSAFSSELTQNPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 452 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPYSPLTHWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 453 - protein, 248 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHDPLIWGRGTMVTVSSGGGGSGGGGSGGGGSAFSSELTQDPAVSVALGQTVRVTCQGDSLRSYYASWYQQKPGQAPVLVIYGKNNRPSGVPDRFSGSSSGNTASLTITGAQAEDEADYYCNSRDSSGNHWVFGGGTELTVLG

SEQ ID NO: 454 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPLTPLLIWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 455 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHTPLHFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 456 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPTDALYFWGRGTMVTVSSGGGGSGGGGSGGGGSAFSSELTQDPAVSVALGQTVRVTCQGDSLRSYYASWYQQRPGQAPVLVIYGKNNRPSGIPDRFSGSSSGNTASLTITGAQAEDEADYYCNSRDSSGNHWVFGGGTELTVLG

SEQ ID NO: 457 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPYTPLLFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 458 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHQPLTFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 459 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPRTYLDFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 460 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHSPLHSWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGSHWVFGGGTELTVLG

SEQ ID NO: 461 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHHSFDLWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 462 - protein, 249 aa, Homo sapiens
QVQLQQSGAEVKKPGSSVRVSCKASGGTFNNDAINWVRQAPGQGLEWMGGIIPMFGTAKYSQNFQGRVAITADESTSTASMELSSLRSEDTAVYYCARSRDLLLFPTSPLQPWGQGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 463 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPTHPLLFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 464 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPSSPLIFWGWGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 465 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPMAPLSPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 466 - protein, 249 aa, Homo sapiens
QVQLQQSGAEVKKPGSSVRVSCKASGGTFSNNAINWVRQAPGQGLEWMGGIIPMFGTAKYSQNFQGRVAITADESTSTASMELSSLRSEDTAVYYCARSRDLLLFPYSGLDAWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 467 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPAAPLSPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 468 - protein, 249 aa, Homo sapiens
QVQLQQPGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPKSPILFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 469 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPTSPLFFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 470 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTAFMELSSLRSEDTAVYYCARSRDLLLFPNSPLFPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 471 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHYGMDVWGRGTMVTVSSGGGGSGGGGSGGGGSAFSSELTQDPAVSVALGQTVRVTCQGDSLRSYYASWYQQKPGQAPVLVIYGRNNRPSGIPDRFSGSSSGNTASLTITGAQAEDEADYYCNSRDSSGNHWVFGGGTELTVLG

SEQ ID NO: 472 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPRSPLLFWSRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 473 - protein, 249 aa, Homo sapiens
QVQLQQSGAEVKKPGSSVRVSCKASGGTFNNNAINWVRQAPGHGLEWMGGIIPMFGTAKYSQNFQGRVAITADESTSTASMELSSLRSEDTAVYYCARSRDLLLFPYHPLLFWGRGTMVTVSSGGGGSGGGGSGGGGSAFSSELTQDPAVSVALGQTVRVTCQGDSLRSYYASWYQQKPGQVPVLVIYGKNNRPSGIPDRFSGSSSGNTASLTITGAQAEDEADYYCNSRDSSGNHWVFGGGTELTVLG

SEQ ID NO: 474 - protein, 249 aa, Homo sapiens
QVQLQQSGAEVKKPGSSVRVSCKASGGTFNNNAINWVRQAPGQGLEWMGGIIPMFGTAKYSQNFQGRVVITADESTSTASMELSSLRSEDTAVYYCARSRDLLLFPSSALRFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 475 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPSPYLSFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 476 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPQAPLFDWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 477 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHAPFTFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 478 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHAPLVLWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 479 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHYGMDVWGRGTMVTVSSGGGGSGGGGSGGGGSAFSSELTQDPAVSVALGRTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 480 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHYPLLFWGRGTMVTVSSGGGGSGGGGSGGGGSAFSSELTQDPAVSVALGQTVRVTCQGDSLRRYYASWYQQKPGQAPVLVIYGKNNRPSGIPDRFSGSSSGNTASLTITGAQAEDEADYYCNSRDSSGSHWVFGGGTELTVLG

SEQ ID NO: 481 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPSSPLSPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 482 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHAPLFTWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 483 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPNDPLLIWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 484 - protein, 248 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHAPLQWGRGTMVTVSSGGGGSGGGGSGGGGSAFSSGLTQDPAVSVALGQTVRVTCQGDSLRSYYASWYQQKPGQAPVLVIYGKNNRPSGIPDRFSGSSSGNTASLTITGAQAEDEADYYCNSRDSSGSHWVFGGGTELTVLG

SEQ ID NO: 485 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPSHAFHEWDRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 486 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPNHPLYPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 487 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPYSPLFPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 488 - protein, 249 aa, Homo sapiens
QVQLQQSGAEVKKPGSSVRVSCKASGGTFNNNAINWVRQAPGQGLEWMGGIIPMFGTARYSQNFQGRVAITADESTSTASMELSSLRSEDTAVYYCARSRDLLLFPQDPLHPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 489 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPDAPLFPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 490 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHSPLLIWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 491 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPGSPLLFWSRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 492 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPSSPLTFWGRGTMVTVSSGGGGSGGGGSGGGGSAFPSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 493 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPTQPLSFWGRGTMVTVSSGGGGSGGGGSGGGGSAFSSELTQDPAVSVALGQTVRVTCQGDSLRSYYASWYQQKPGQAPVLVIYGKNNRPLGIPDRFSGSSSGNTASLTITGAQAEDEADYYCNSRDSSGNHWVFGGGTELTVLG

SEQ ID NO: 494 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPLSPLWPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 495 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTGTASMELSSLRSEDTAVYYCARSRDLLLFPTFPLLFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 496 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTGTASMELSSLRSEDTAVYYCARSRDLLLFPHDPLLLWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 497 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPYSPLLFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 498 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHSPLRIWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 499 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPRAPLLFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 500 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPRTPLTFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 501 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPLAPLSFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 502 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPNQPLSFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 503 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPLEPMHFWGRGTMVTVSSGGGGSGGGGSGGGGSAFSSELTQDPAVSVALGQTVRVTCQGDSLRGYYASWYQQKPGQAPVLVIYGKNNRPSGIPDRFSGSSSGNTASLTITGAQAEDEADYYCNSRDSSGNHWVFGGGTELTVLG

SEQ ID NO: 504 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPSAPLTFWSRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 505 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPSHPLLFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 506 - protein, 249 aa, Homo sapiens
QVQLQQSGAEVKKPGSSVRVSCKASGGTFNNNAINWVRQAPGQGLEWMGGIIPMFGTAKYSQNFQGRVVITADESTSTASMELSSLRSEDTAVYYCARSRDLLLFPRTPLVFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCSSRDSSGNHWVFGGGTELTVLG

SEQ ID NO: 507 - protein, 249 aa, Homo sapiens
QVQLQQSGAEAKKPGSSVRVSCKASGGTFNNNAINWVRQAPGQGLEWMGGIIPMFGTAKYSQNFQGRVAITADESTSTASMELSSLRSEDTAVYYCARSRDLLLFPGSPLTFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 508 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPTAPLLFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 509 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPSAPLDFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 510 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPSHPLSFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 511 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPSFPLLFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 512 - protein, 249 aa, Homo sapiens
QVQLVESGGGVVQPGRSLRLSCAASGFTFSSYGMHWVRQAPGKGLEWVAAISYDGSNKYYADSVKGRFTISRDNSKNTLYLQMNSLRAEDTAVYYCAKDGYYDILTGYSYYGMDVWGQGTMVTVSSGGGGSGGGGSGGGGSSELTQDPAVSVALGQTVRITCQGDSLRSYYTNWFQQKPGQAPLLVVYAKNKRPSGIPDRFSGSSSGNTASLTITGAQAEDEADYYCNSRDSSGNHVVFGGGTKLTVLG

SEQ ID NO: 513 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPAKPLLFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 514 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPNSTLSFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 515 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPDAPLTPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 516 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHEPLLIWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 517 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPTYPLSFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 518 - protein, 249 aa, Homo sapiens
QVQLQQSGAEVKKPGSSVRVSCKASGGTFDNNAINWVRQAPGQGLEWMGGIIPMFGTAKYSQNFQGRVAITADESTSTASMELSSLRSEDTAVYYCARSRDLLLFPTEPLVLWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 519 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPTYPLHFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 520 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHDPLTFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 521 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPQAPLTNWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 522 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHAPLEAWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 523 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPDHPLLFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 524 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPRAPLSFWGRGTMVTVSSGGGGSGGGGSGGGGSAFSSELTQDSAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 525 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPRGPLRFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 526 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPFTPLTFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 527 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPQHPLSPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 528 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPSAPIVFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 529 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPQAPLTFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 530 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPRAPLRFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 531 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPRTPLTFWGRGTMVTVSSGGGGSGGGGSGGGGSAFSSELTQDPAVSVALGQTVRVTCQGDSLRSHYASWYQQKPGQAPVLVIYGKNNRPSGIPDRFSGSSSGNTASLTITGAQAEDEADYYCNSRDSSGNHWVFGGGTELTVLG

SEQ ID NO: 532 - protein, 249 aa, Homo sapiens
QVQLQQSGAEVKKPGSSVRVSCKASGGTFNNNAINWVRQAPGQGLEWIGGIIPMFGTAKYSQNFQGRVAITADESTSTASMELSSLRSEDTAVYYCARSRDLLLFPHAPLDFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWAFGGGTGLTVLG

SEQ ID NO: 533 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHAGFDSWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 534 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPYSPLSFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 535 - protein, 249 aa, Homo sapiens
QVQLQQSGAEVKKPGSSVRVSCKASGGTFNNNAINWVRQAPGQGLEWVGGIIPMFGTAKYSQNFQGRVAITADESTSTASMELSSLRSEDTAVYYCARSRDLLLFPGRPLTFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 536 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPAEHLLFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 537 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPTAPLHPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 538 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHEPLTAWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 539 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHAPLFEWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 540 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPRAPLDFWGRGTMVTVSSGGGGSGGGGSGGGGSAFSSELTQDPAVSVALGQTVRVTCQGDSLRSYYASWYQQKPGQAPVLVTYGKNNRPSGIPDRFSGSSSGNTASLTITGAQAEDEADYYCNSRDSSGTHWVFAEGTKLTVLG

SEQ ID NO: 541 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPFGTLRFWGRGTMVTVSSGGGGSGGGGSGGGGSAFSSELTQDPAVSVALGQTVRVTCQGDSLRSYYASWYQQKPGQAPVLVIYGRNNRPSGIPDRFSGSSSGNTASLTITGAQAEDEADYYCNSRDSSGNHWVFGGGTELTVLG

SEQ ID NO: 542 - protein, 249 aa, Homo sapiens
QVQLQQSGAEVKKPGSSVRVSCKASGGTFNNNAINWVRQAPGQGLEWMGGIIPMFGTAKYSQNSQGRVAITADESTSTASMELSSLRSEDTAVYYCARSRDLLLFPSSPLVFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 543 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPRDPLAFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 544 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPTSPLSFWGRGTMVTVPSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGSHWVFGGGTELTVLG

SEQ ID NO: 545 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHAPLLLWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 546 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPSAPISFWGQGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 547 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPQGPLSFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 548 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPGSPLHPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 549 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPSDPLSFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 550 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCAWSRDLLLFPHDGLAPWGRGTMVTVSSGGGGSGGGGSGGGGSAFSSELTQDPAVSVALGQTVRVTCQGDSLRNYYASWYQQKPGQAPVLVIYGKNNRPSGIPDRFSGSSSGNTASLTITGAQAEDEADYYCNSRDSSGNHWVFGGGTELTVLG

SEQ ID NO: 551 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPTSPLTFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 552 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPNGPLHPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 553 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPQAPLSFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 554 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPTAPLSFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 555 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPFFPLQFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 556 - protein, 249 aa, Homo sapiens
QVQLQRSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPLDPLHFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 557 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPSEPLQLWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 558 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPFAPLRFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 559 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPLHPLIFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 560 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRPEDTAVYYCARSRDLLLFPHYPLLFWSRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 561 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPRDPLRIWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 562 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPSNPLTFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNRWVFGGGTELTVLG

SEQ ID NO: 563 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPTAPLEIWGRGTMVTVSSGGGGSGGGGSGGGGSAFSSELTQDPAVSVALGQTVRVTCQGDSLRSYHASWYQQKPGQAPVLVIYGKNNRPSGIPDRFSGSSSGNTASLTITGAQAEDEADYYCNSRDSSGNHWVFGGGTELTVLG

SEQ ID NO: 564 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCAKSRDLLLFPRDPLQFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 565 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHEPLAFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 566 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPRAPLAFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 567 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPYSPLAFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 568 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHTPLDSWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 569 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHTPLTFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 570 - protein, 249 aa, Homo sapiens
QVQLQQSGAEVKKPGSSVRVSCKASGGTFNNNAINWVRQAPGQGLEWMGGITPMFGTAKYSQNFQGRVAITADESTSTASMELSSLRSEDTAVYYCARSRDLLLFPSEPLRIWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 571 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPTAPLDFWGRGTMVTVSSGGGGSGGGGSGGGGSAFSSELTQGPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 572 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPNRGLDLWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 573 - protein, 249 aa, Homo sapiens
QVQLQQSGAEVKKPGSSVRVSCKASGGTFNNNAINWVRQAPGQGLEWMGGIIPMFGTAKYSRNFQGRVAITADESTSTASMELSSLRSEDTAVYYCARSRDLLLFPYDPLFMWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 574 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHAPLYPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 575 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPSAPLAFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 576 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHSPITFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 577 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPRYPLFFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 578 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPYAPLDFWGRGTMVAVSSGGGGSGGGGSGGGGSAFSSELTQDPAVSVALGQTVRVTCQGDSLRSYYASWYQQKPGQAPVLVIYGKNNRPSGIPDRFSGSNSGNTASLTITGAQAEDEADYYCNSRDSSGNHWVFGGGTELTVLG

SEQ ID NO: 579 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPRDPLQFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 580 - protein, 249 aa, Homo sapiens
QVQLQQSGAEVKKPGSSVRVSCKASGGTFDNNAINWVRQAPGQGLEWMGGIIPMFGTAKYSQNFQGRVAITADESTSTASMELSSLRSEDTAVYYCARSRDLLLFPHAPLELWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 581 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPSAPLTFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 582 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPTAPLAFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 583 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHSPLDFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 584 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPSHPLTFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 585 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPAHPLVIWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 586 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTGTASMELSSLRSEDTAVYYCARSRDLLLFPQAPLYPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 587 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPTAPLTFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 588 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPTTPLHFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 589 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHYPLLFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 590 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHHPLSFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 591 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPYHSYDIWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 592 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPYATLSFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 593 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPNSPLAPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 594 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPYSPLQPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 595 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPQGPLSFWGRGTMVTVSSGGGGSGGGGSGGGGSAFSSELTQDPAVSVALGQTVRVTCQGDSLRSYYASWYQQKPGQAPVLVIYGKNNRPSGIPVRFSGSSSGNTASLTITGAQAEDEADYYCNSRDSSGNHWVFGGGTELTVLG

SEQ ID NO: 596 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHDPLAPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 597 - protein, 248 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHSPLLWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 598 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPNGALRFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 599 - protein, 249 aa, Homo sapiens
QVQLQQSGAEVKKPGSSVRVSCKASGGTFNNNAINWVRQAPGQGLEWMGGIIPMFGTAKYSQNFQGRVAITVDESTSTASMELSSLRSEDTAVYYCARSRDLLLFPYSPLRFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 600 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPDAPLHPWGRGTMVTVSSGGGGSGGGGSGGGGSAFSSELTQDPAVSVALGQTVRVTCQGDSLRSYYASWYQQKPGQAPVLVIYGKNNRPSGVPDRFSGSSSGNTASLTITGAQAEDEADYYCNSRDSSGNHWVFGGGTELTVLG

SEQ ID NO: 601 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPQAPLFPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 602 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPSAPLWPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 603 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPKSPLAFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 604 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTGTASMELSSLRSEDTAVYYCAGSRDLLLFPSSPLHPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 605 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPNHPLTFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 606 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPNAPLDSWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 607 - protein, 249 aa, Homo sapiens
QVQLQRSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPYAPLDFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 608 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPSSPLEFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 609 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPRAPLFFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 610 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPMAPLVGWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 611 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPLAPLHPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 612 - protein, 249 aa, Homo sapiens
QVQLQQSGAEVKKPGSSVRVSCKASGGTFNNNAINWVRQAPGQGLEWMGGITPMFGTAKYSQNFQGRVAITADESTSTASMELSSLRSEDTAVYYCARSRDLLLFPHDPLGFWGRGTMVTVSSGGGGSGGGGSGGGGSAFSSELTQDPAVSVALGQTVRVTCQGDSLRSYYASWYQQKPGQAPVLVTYGKNNRPSGIPDRFSGSSSGNTASLTITGAQAEDEADYYCNSRGSSGNHWVFGGGTELTVLG

SEQ ID NO: 613 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAMYYCARSRDLLLFPHYGMDVWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 614 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPQSPLLFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 615 - protein, 249 aa, Homo sapiens
QVQLQQSGAEVKKPGSSVRVSCKASGGTFNNNAINWVRQAPGQGLEWMGGITPMFGTAKYSQNFQGRVAITADESTSTASMELSSLRSEDTAVYYCARSRDLLLFPHEHLSFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 616 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHSPLDFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSSNHWVFGGGTELTVLG

SEQ ID NO: 617 - protein, 249 aa, Homo sapiens
QVQLQQSGAEVKKPGSSVRVSCKASGGTFNNNAINWVRQAPGQGLEWIGGIIPMFGTAKYSQNFQGRVAITADESTSTASMELSSLRSEDTAVYYCARSRDLLLFPHSPLSPWGRGTMVTVLSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 618 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHYGMDVWGRGTMVTVSSGGGGSGGGGSGGGGSAFSSELTQDPAVSVALGQTVRVTCQGDSLRSYYASWYQQKPGQAPVLVIYGSNNRPSGIPDRFSGSSSGNTASLTITGAQAEDEADYYCNSRDSSGNHWVFGGGTELTILG

SEQ ID NO: 619 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTAFMELSSLRSEDTAVYYCARSRDLLLFPNAALYPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 620 - protein, 249 aa, Homo sapiens
QVQLQQSGAEVKKPGSSVRVSCKASGGTFNNNAINWVRQAPGQGLEWMGGITPMFGTAKYSQNFQGRVAITADESTSTASMELSSLRSEDTAVYYCARSRDLLLFPNDPLFGWGRGTMVTVSSGGGGSGGGGSGGGGSAFSSELTQDPAVSVALGRTVKVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 621 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPGAPLSPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 622 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARARDLLLFPAAPLWPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 623 - protein, 248 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPNDPLRWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 624 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPTAPLDPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 625 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPTAPLFPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQADDEADYYCNSRDSSGNHWVFGGGTELTVLG

SEQ ID NO: 626 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPSDPLVFWGRGTMVTVSSGGGGSGGGGSGGGGSAFSSELTQDPAVSVALGQTVRVTCQGDSLRSYYASWYQQKPGQAPVLVIYGKNNRPSGITDRFSGSSSGNTASLTITGAQAEDEADYYCNSRDSSGNHWVFGGGTELTVLG

SEQ ID NO: 627 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPGSPLTFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 628 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPYSHLEFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTATLTITGAQAEDEADYYCNSRDSSGNHWVFGGGTELTVLG

SEQ ID NO: 629 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPQSPLHPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 630 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPQAPLFPWGRGTMVTVSSGGGGSGGGGSGGGGSAFSSELTQDPAVSVALGQTVRVTCQGDSLRSYYANWYQQKPGQAPVLVIYGKNNRPSGIPDRFSGSSSGNTASLTITGAQAEDEADYYCNSRDSSGNHWVFGGGTELTVLG

SEQ ID NO: 631 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPYAPLTFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 632 - protein, 249 aa, Homo sapiens
QVQLQQSGAEVKKPGSSVRVSCKASGGTFNNDAINWVRQAPGQGLEWMGGIIPMFGTAKYSQNFQGRVAITADESTSTASMELSSLRSEDTAVYYCARSRDLLLFPQNPLHPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 633 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHEPLCFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 634 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPSAPLSFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFDGGTELTVLG

SEQ ID NO: 635 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPMAPLRFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 636 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPRSPLSFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSNSGNTASLTITGAQAEDEADYYCNSRDSSGNHWVFGGGTELTVLG

SEQ ID NO: 637 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPSAPLYPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 638 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPRDPLQFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFDGGTELTVLG

SEQ ID NO: 639 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPTAPLTFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFDGGTELTVLG

SEQ ID NO: 640 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTVSMELSSLRSEDTAVYYCARSRDLLLFPYSPLYPWGRGTMVTVSSGGGGSGGGGSGGGGSAFSSELTQDPAVSVASGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 641 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPASPLIFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGVQAEDEADYYCNSRDSSGNHWVFGGGTELTVLG

SEQ ID NO: 642 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPRHPLLFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 643 - protein, 248 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHAPLEWGRGTMVTVSSGGGGSGGGGSGGGGSAFSSELTQDPAVSVALGQTVRVTCQGDSLRSYYASWYQQKAGQAPVLVIYGKNNRPSGIPDRFSGSSSGNTASLTITGAQAEDEADYYCNSRDSSGNHWVFGGGTELTVLG

SEQ ID NO: 644 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHAPLHPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 645 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHFPLIFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFDGGTELTVLG

SEQ ID NO: 646 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHEPLIFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFDGGTELTVLG

SEQ ID NO: 647 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPNHAFDLWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 648 - protein, 249 aa, Homo sapiens
QVQLQQSGAEVKKPGSSVRVSCKASGGTFNNDAINWVRQAPGQGLEWMGGIIPMFGTAKYSQNFQGRVAITADESTSTASMELSSLRSEDTAVYYCARSRDLLLFPHTILYPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 649 - protein, 249 aa, Homo sapiens
QVQLQQSGAEVKKPGSSVRVSCKASGGTFNNDAINWVRQAPGQGLEWMGGIIPMFGTAKYSQNFQGRVAITADESTSTASMELSSLRSEDTAVYYCARSRDLLLFPDWPLYPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 650 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHYPLFLWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 651 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPQAPLHPWGRGTMVTVSGGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 652 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHAPMDPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 653 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPRAPLTFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 654 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPRATLEFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 655 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHSPLFPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 656 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPNDPLVLWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSDNHWVFGGGTELTVLG

SEQ ID NO: 657 - protein, 249 aa, Homo sapiens
QVQLQQSGAEVKKPGSSVRISCKASGGTFNNNAINWVRQAPGQGLEWMGGIIPMFGTAKYSQNFQGRVAITADESTSTASMELSSLRSEDTAVYYCARSRDLLLFPHDPLYIWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 658 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPYAPLSFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 659 - protein, 249 aa, Homo sapiens
QVQLQQSGAEVKKPGSSVRVSCKASGGTFSNNAINWVRQAPGQGLEWMGGIIPMFGTAKYSQNFQGRVAITADESTSTVSMELSSLRSEDTAEYYCARSRDLLLFPASPLNPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 660 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHDPLSPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 661 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPRDPLRFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 662 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPGDPLDFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 663 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHGPLTFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 664 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHAPLSPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGSHWVFGGGTELTVLG

SEQ ID NO: 665 - protein, 249 aa, Homo sapiens
QVQLQQSGAEVKKPGSSVRISCKATGGTFNNDAINWVRQAPGQGLEWMGGIIPMFGTAKYSQNFQGRVAITADESTGTASMELSSLRSEDTAVYYCARSRDLLLFPSSPLILWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEANYYCNSRDSSGNHWVFGGGTELTVLG

SEQ ID NO: 666 - protein, 249 aa, Homo sapiens
QVQLQQSGAEVKKPGSSVRVSCKASGGTFNNNAINWVRQAPGRGLEWMGGIIPMFGTAKYSQNFQGRVAITADESTSTASMELSSLRSEDTAVYYCARSRDLLLFPNSPLSPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 667 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPQDPLVFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 668 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPKAPLVFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 669 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHAPLRFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 670 - protein, 249 aa, Homo sapiens
QVQLQQSGAEVKKPGSSVRVSCKASGGTFNNDAINWVRQAPGQGLEWMGGIIPMFGTAKYSQNFQGRVAITADESTSTASMELSSLRSEDTAVYYCARSRDLLLFPRAPLAPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 671 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPTAPLNFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 672 - protein, 249 aa, Homo sapiens
QVQLQQSGAEVKKPGSSVRVSCKASGGTFNINAINWVRQAPGQGLEWMGGIIPMFGTAKYSQNFQGRVAITADESTSTASMELSSLRSEDTAVYYCARSRHLLLFPQGPLSFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 673 - protein, 249 aa, Homo sapiens
QVQLQQSGAEVKKPGSSVRVSCKASGGTFNNDAINWVRQAPGQGLEWMGGIIPMFGTAKYSQNFQGRVAITADESTSTASMELSSLRSEDTAVYYCARSRDLLLFPHLPLNPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 674 - protein, 249 aa, Homo sapiens
QVQLQQSGAEVKKPGSSVRVSCKASGGTFNNDAINWVRQAPGQGLEWMGGIIPMFGTAKYSQNFQGRVAITADESTSTASMELSSLRSEDTAVYYCARSRDLLLFPHHSFDLWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 675 - protein, 249 aa, Homo sapiens
QVQLQQSGAEVKKPGSSVRVSCKASGGTFNNDAINWVRQAPGQGLEWMGGIIPMFGTAKYSQNFQGRVAITADESTSTASMELSSLRSEDTAVYYCARSRDLLLFPGAPLAPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 676 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPQAPLYPWGRGTMVTVSSGGGGSGGGGSGGGGSAFSSELTQDPAVSVALGQTVRVTCQGDSLRSYYASWYQQKPGQAPVLVIYGKNNRPSGVPDRFSGSSSGNTASLTITGAQAEDEADYYCNSRDSSGNHWVFGGGTELTVLG

SEQ ID NO: 677 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPRSPLSFWGRGTMVTVSSGGGGSGGGGSGGGGSAFSYELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 678 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPSHSFDIWGRGTMVTVSSGGGGSGGGGSGGGGSAFSYELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFDGGTELTVLG

SEQ ID NO: 679 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPYSPLHPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 680 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPYSPLSFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRHSSGNHWVFGGGTELTVLG

SEQ ID NO: 681 - protein, 249 aa, Homo sapiens
QVQLQQSGAEVKKPGSSVRVSCKASGGTFNNNAINWVRQAPGQGLEWMEGIIPMFGTAKYSQNFQGRVAITADESTSTASMELSSLRSEDTAVYYCARSRDLLLFPHHSFDLWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 682 - protein, 249 aa, Homo sapiens
QVQLQQSGAEVKKPGSSVRVSCKASGGTFNNNAINWVRQAPGQRLEWMGGIIPMFGTAKYSQNFQGRVAITADESTSTASMELSSLRSEDTAVYYCARSRDLLLFPHHSFDLWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 683 - protein, 249 aa, Homo sapiens
QVQLQQSGAEVKKPGSSVRVSCKASGGTFSNNAINWVRQAPGQGLEWMGGIIPMFGTAKYSQNFQGRVAITADESTSTASMELSSLRSEDTAVYYCARSRDLLLFPASPLNPWGRRTMVTVSSGGGGSGGGGSGGGGSAFSSELTQDPAVSVALGQTVRVTCQGDSIRSYYASWYQQKPGQAPVLVIYGKNNRPSGIPDRFSGSSSGNTASLTITGAQAEDEADYYCNYRDSSGNHWVFGGGTELTVLG

SEQ ID NO: 684 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHEPLSPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 685 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPLDPLIIWGRGTMVAVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNYRDSSGNHWVFGGGTELTVLG

SEQ ID NO: 686 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPRAPLAFWGRGTMVTVSSGGGGSGGGGSGGGGSAFSSELTQDPAVSVALGQTVRVTCQGDSLRGYYASWYQQKPGQAPVLVIYGKNNRPSGIPDRFSGSSSGNTASLTITGAQAEDEADYYCNSRDSSGNHWVFGGGTELTVLG

SEQ ID NO: 687 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPSSPLSFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 688 - protein, 249 aa, Homo sapiens
QVQLQQSGAEVKKPGSSVRVSCKASGGTFNNNAINWVRQAPGQRLEWMGGIIPMFGTAKYSQNFQGRVAITADESTSTASMELSSLRSEDTAVYYCARSRDLLLFPHYGMDVWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 689 - protein, 249 aa, Homo sapiens
QVLLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPRAPLDFWGRGTMVTVSSGGGGSGGGGSGGGGSAFSSELTQDPAVSVALGQTVRVTCQGDSLRSHYASWYQQKPGQAPVLVIYGKNNRPSGIPDRFSGSSSGSTASLTITGAQAEDEADYYCNSRDSSGNHWVFGGGTELTVLG

SEQ ID NO: 690 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPRSPLTFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 691 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPQHGFDAWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 692 - protein, 249 aa, Homo sapiens
QVQLQQSGAEVKKPGSSVRVSCKASGGTFNNNAINWVRQAPGQGPEWMGGIIPMFGTAKYSQNFQGRVAITADESTSTASMELSSLRSEDTAVYYCARSRDLLLFPRDPLRFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 693 - protein, 249 aa, Homo sapiens
QVLLQQSGAEVKKPGSSVRVSCKASGGTFSNNAINWVRQAPGQGLEWMGGIIPMFGTAKYSQNFQGRVAITADESTSTASMELSSLRSEDTRVYYCARSRDLLLFPRDPLSFWGRGTMVTVSSGGGGSGGGGSGGGGSAFSSELTQDPAVCVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 694 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPYAPLAFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 695 - protein, 249 aa, Homo sapiens
QVQLQQSGAEVRKPGSSVRVSCKASGGTFNNNAINWVRQAPGQGLEWMGGIIPMFGTAKYSQNFQGRVAITADESTSTASMELSSLRSEDTAVYYCARSRDLLLFPHAAFDVWGRGTMVTVSSGGGGSGGGGSGGGGSAFSYELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 696 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHEPLFPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 697 - protein, 249 aa, Homo sapiens
QVQLQQSGAEVKKPGSSVRVSCKASGGTFNNDAINWVRQAPGQGLEWMGGIIPMFGTAKYSQNFQGRVAITADESTSTASMELSSLRSEDTAVYYCARSRDLLLFPRSALTFWGRGTMVTVSSGGGGSGGGGSGGGGSAFSYELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 698 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHHSFDSWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 699 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTAFMELSSLRSEDTAVYYCARSRDLLLFPHYGMDVWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 700 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPNSPLHPWGRGTMVTVSSGGGGSGGGGSGGGGSAFSYELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 701 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHHPLDSWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 702 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPQAPLHPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 703 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPSWPLTFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGTAASLTITGAQAEDEADYYCNCRDSSGNHWVFGGGTELAVLG

SEQ ID NO: 704 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHYPLLFWGRGTMVTVSSGGGGSGGGGSGGGGSAFSYELTQDPAVSVALGQTVRVTCQGDSLRRYYASWYQQKPGQAPVLVIYGKNNRPSGIPDRFSGSSSGNTASLTITGAQAEDEADYYCNSRDSSGSHWVFGGGTELTVLG

SEQ ID NO: 705 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPTYPLVFWGRGTMVTVSSGGGGSGGGGSGGGGSAFSSELTHDPAVSVALGQTVRVTCQGDSLRSYYASWYQQKPGQAPVLVIYGKNNRPSGIPDRFSGSSSGNTASLTITGAQAEDEADYYCNYRDSSGNHWVFGGGTELTVLG

SEQ ID NO: 706 - protein, 249 aa, Homo sapiens
QVQLQQSGAEVKKPGSSVRVSCKASGGTFSNNAINWVRQAPGQGLEWMGGIIPMFGTAKYSQNFQGRVAITADESTSTASMELSSLRSEDTAVYYCARSRDLLLFPHAPLHPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 707 - protein, 249 aa, Homo sapiens
QVLLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPKHPLVFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGNELTVLG

SEQ ID NO: 708 - protein, 249 aa, Homo sapiens
QVQLQQSGAEVKKPGSSVRVSCKASGGTFSNNAINWVRQAPGQGLDWMGGIIPMFGTAKYSQNFQGRVAITADESTSTASMELSSLRSEDTAVYYCARSRDLLLFPASPLNPWGRGTMVTVSSGGGGSGGGGSGGGGSAFSYELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 709 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHHSFDAWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 710 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHDPLLFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 711 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPRHPLVFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 712 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPRAPLYPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 713 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHAPLDPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 714 - protein, 249 aa, Homo sapiens
QVQLQQSGAEVKKPGSSVRVSCKASGGTFSNNAINWVRQAPGQGLEWMGGIIPMFGTAKYSQNFQGRVAITADESTSTASMELSSLRSEDTAVYYCARSRDLLLFPNAPLSPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 715 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPQAPLSPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 716 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHAPLSFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 717 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHAPLFPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 718 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPASPLTFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 719 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHYGMDVWGRGTMVTVSSGGGGSGGGGSGGGGSAFSSGLTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 720 - protein, 247 aa, Homo sapiens
QVQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHYPLLFWGRGTMVTVSSGGGGSGGGGSGGGGSAFSSELTQDPAVSVALGQTVRVTCQGDSLRRYYASWYQQKPGQAPVLVIYGKNNRPSGIPDRFSGSSSGNTASLTITGAQAEDEADYYCNSRDSSGSHWVFGGGTELTVLG

SEQ ID NO: 721 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHYGMYVWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 722 - protein, 249 aa, Homo sapiens
QVQLQRSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHYPLHPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 723 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHAPLAPWGRGTMVTVSSGGGGSGGGGSGGGGSAFSSELTQDPAVSVALGQTVRVTCRGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 724 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPQAPLEPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 725 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPSHAFDLWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 726 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPYAPLDFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 727 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPNAPLSFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 728 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPSHSFDVWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 729 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHHSFDTWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 730 - protein, 249 aa, Homo sapiens
QVQLQQSGAEVKKPGSSVRVSCKASGGTFNNDAINWVRQAPGQGLEWMGGIIPMFGTAKYSQNFQGRVAITADESTSTASMELSSLRSEDTAVYYCARSRDLLLFPMLGLDLWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 731 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPRAPLDFWGRGTMVTVSSGGGGSGGGGSGGGGSAFSSELTQDPAVSVALGQTVRVTCQGDSLRSHYASWYQQKPGQAPVLVIYGKNNRPSGIPDRFSGSSSGSTASLTITGAQAEDEADYYCNSRDSSGNHWVFGGGTELTVLG

SEQ ID NO: 732 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPRSPLLFWGRGTMVTVSSGGGGSGGGGSGGGGSAFSSELTQDPAVSVALGQTVRVTCQGDSLRSYYASWYQQKPGQAPVLVIHGKNNRPSGIPDRFSGSSSGNTASLTITGAQAEDEADYYCNSRDSSGNHWVFGGGTELTVLG

SEQ ID NO: 733 - protein, 249 aa, Homo sapiens
QVQLQQPGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPKAPLTFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 734 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTVSMELSSLRSEDTAVYYCARSRDLLLFPSAPLSPWGRGTMVTVSSGGGGSGGGGSGGGGSAFSSELTQDPAVSVALGQTARVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 735 - protein, 249 aa, Homo sapiens
QVQLQQSGAEVKKPGSSVRVSCKASGGTFNNNAINWVRQAPGQGLEWMGGIIPMFGTAKYSQNFQGRVAITADKSTSTASMELSSLRSEDTAVYYCARSRDLLLFPHAPLAPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 736 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCAGSRDLLLFPSAPLAPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 737 - protein, 249 aa, Homo sapiens
QVQLQQSGAEVKKPGSSVRVSCKASGGTFSNNAINWVRQAPGQGLEWMGGIIPMFGTAKYSQNFQGRVAITADESTSTASMELSSLRSEDTAVYYCARSRDLLLFPRTPLLFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 738 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPNAPLSPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNRWVFGGGTELTVLG

SEQ ID NO: 739 - protein, 249 aa, Homo sapiens
QVQLQQSGAEVKKPGSSVKVSCKASGGTFNNNAINWVRQAPGQGLEWMGGIIPMFGTAKYSQNFQGRVAITADESTGTASMELSSLRSEDTAVYYCARSRDLLLFPSAPLYPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 740 - protein, 249 aa, Homo sapiens
HVQLPQAGAEVKKPGSSVRVSCKASGGTFNNNAINWVRQAPGQGLEWMGGITPMFGTAKYSQNFQGRVAITADESTSTASMELSSLRSEDTAVYYCARSRDLLLFPHHSFDLWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 741 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPRAPLSFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 742 - protein, 249 aa, Homo sapiens
QVQLQQSGAEVKKPGSSVRVSCKASGGTFNNNAINWVRQAPGQGFEWMGGIIPMFGTAKYSQNFQGRVAITADESTSTASMELSSLRSEDTAVYYCARSRDLLLFPHYPLEMWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 743 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHAPLAPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 744 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHHSFDLWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGVGTELTVLG

SEQ ID NO: 745 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPRDPLLFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 746 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCAMSRDLLLFPLSPLVPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 747 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHDPLGFWGRGTMVTVSSGGGGSGGGGSGGGGSAFSSELTQDPAVSVALGQTVRVTCQGDSLRSYYASWYQQKPGQAPVLVTYGKNNRPSGIPDRFSGSSSGNTASLTITGAQAEDEADYYCNSRGSSGNHWVFGGGTELTVLG

SEQ ID NO: 748 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHHSLLFWGRGTMVTVSSGGGGSGGGGSGGGGSAFSSELTQDPAVSVALGQTVRVTCQGDSLRRYYASWYQQKPGQAPVLVIYGKNNRPSGIPDRFSGSSSGNTASLTITGAQAEDEADYYCNSRDSSGSHWVFGGGTELTVLG

SEQ ID NO: 749 - protein, 249 aa, Homo sapiens
QVQLQQSGAEVKKPGSSVRVSCKASGGTFSNNAINWVRQAPGQGLEWMGGIIPMFGTAKYSQNFQGRVAITADESTSTASMELSSLRSEDTAVYYCARSRDLLLFPASPLNPWGRGTMVTVSSGGGGSGGGGSGGGGSAFSSELTQDPAVSVALGQTVRVTCQGDSLRSHYASWYQQKPGQAPVLVIYGKNNRPSGIPDRFSGSSSGNTASLTITGAQAEDEADYYCNSRDSSGNHWVFGGGTELTVLG

SEQ ID NO: 750 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPASPLNPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 751 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTVSMELSSLRSEDTAVYYCARSRDLLLFPSAPLNPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 752 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHHSFDLWGRGTMVTVSSGGGGSGGGGSGGGGSAFSSELTQDPAVSVALGQTVRVTCQGDSLRSYYASWYQQKPGQAPVLVIYGKNSRPSGIPDRFSGSSSGNTASLTITGAQAEDEADYYCNSRDSSGNHWVFDGGTELTVLG

SEQ ID NO: 753 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCAGSRDLLLFPKHPLRFWGRGTMVTVSSGGGGSGGGGSGGGGSAFPSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 754 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHAPLFPWSRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 755 - protein, 249 aa, Homo sapiens
QVQLQQSGAEVKKPGSSVRVSCKASGGTFSNNAINWVRQAPGQGLEWMGGIIPMFGTAKYSQNFQGRVAITADESTSTASMELSSLRSEDTAVYYCARSRDLLLFPHAPLDPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 756 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHYPLLFWGRGTMVTVSSGGGGSGGGGSGGGGSAFSSELTQDPAVSVALGQTVRVTCQGDSLRRYYASWYQQKPGQAPVLVIYGKNNRPSGIPDRFSGSSSGNTASLTITGAQAEDEADYYCNSRDSSGNHWVFGGGTELTVLG

SEQ ID NO: 757 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPSAPLSPWGRGTMVTVSSGGGGSGGGGSGGGGSAFSSELTQDPAVSVALGQTARVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 758 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPRDPLDLWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 759 - protein, 249 aa, Homo sapiens
QVQLQQSGAEVKKPGSSVRVSCKASGGTFNNDAINWVRQAPGQGLEWMGGIIPMFGTAKYSQNFQGRVAITADESTSTASMELSSLRSEDTAVYYCARSRDLLLFPRDPLEFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWMFGGGTELTVLG

SEQ ID NO: 760 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPNAPLSPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 761 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHYPFDAWGRGTMVTVSSGGGGSGGGGSGGGGSAFSSELTQDPAVSVALGQTVRVTCQGDSLRRYYASWYQQKPGQAPVLVIYGKNNRPSGIPDRFSGSSSGNTASLTITGAQAEDEADYYCNSRDSSGSHWVFGGGTELTVLG

SEQ ID NO: 762 - protein, 249 aa, Homo sapiens
QVQLQQSGAEVKKPGSSVRVSCKASGGTFNNNAINWVRQAPGQGPEWMGGIIPMFGTAKYSQNFQGRVAITADESTSTASMELSSLRSEDTAVYYCARSRDLLLFPRDPLRFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFDGGTELTVLG

SEQ ID NO: 763 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTAFMELSSLRSEDTAVYYCARSRDLLLFPDAPLAPWGRGTMVTVSSGGGGSGGGGSGGGGSAFSSELTQDPAVSVALGQTVRVTCQGDSLRSYYASWYQQKPGQAPVLVIYGKNNRPSGIPGRFSGSSSGNTASLTITGAQAEDEADYYCNSRDSSGNHWVFGGGTELTVLG

SEQ ID NO: 764 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPRAPLAPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 765 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHHSLLFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 766 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTGTASMELSSLRSEDTAVYYCARSRDLLLFPHHPLTFWGWGTMVTVSSGGGGSGGGGSGGGGSAFSSELTQDPAVSVALGQTVRVTCQGDSLRRYYASWYQQKPGQAPVLVIYGKNNRPSGIPDRFSGSSSGNTASLTITGAQAEDEADYYCNSRDSSGSHWVFGGGTELTVLG

SEQ ID NO: 767 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTGTASMELSSLRSEDTAVYYCARSRDLLLFPHHPLTFWGWGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 768 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPRDPLHFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 769 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPNAPLNPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 770 - protein, 249 aa, Homo sapiens
QVQLQQSGAEVKKPGSSVRVSCKASGGTFSNNAINWVRQAPGQGLEWMGGIIPMFGTAKYSQNFQGRVAITADESTSTASMELSSLRSEDTAVYYCARSRDLLLFPHHSFDLWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 771 - protein, 249 aa, Homo sapiens
  Site (26): Xaa equals any of the naturally occurring L-amino acids
  Site (31): Xaa equals any of the naturally occurring L-amino acids
QVQLQQSGAELKKPGSSVRVSCKASXGTFSXNAINWVRQAPGQGLEWMGGIIPMFGTAKYSQNFQGRVAITADESTSTASMELSSLRSEDTAVYYCARSRDLLLFPASPLNPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 772 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPQAPLHPWGRGTMVTVSSGGGGSGGGGSGGGGSAFSSELTQDPAVSVALGQTVRVTCQGDSLRSHYASWYQQKPGQAPVLVIYGKNNRPSGIPDRFSGSSSGNTASLTITGAQAEDEADYYCNSRDSSGNHWVFGGGTELTVLG

SEQ ID NO: 773 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTGSMELSSLRSEDTAVYYCARSRDLLLFPHHSFDLWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 774 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPQHGLDLWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 775 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPRDPLLFWGRGTMVTVSSGGGGSGGGGSGGGGSAFSSELTQDPAVSVALGQTVRVTCQGDSLRSYYASWYQQKPGQAPVLVVYGKNNRPSGIPDRFSGSSSGNTASLTITGAQAEDEADYYCNSRDSSGNHWVFGGGTELTVLG

SEQ ID NO: 776 - protein, 249 aa, Homo sapiens
QVQLQQSGAEVKKPGSSVRVSCKASGGTFNNNAINWVRQAPGQGLEWMGGIIPMFGTAKYSQNFQGRVAITEDESTSTVSMELSNLRSEDTAVYYCARSRDLLLFPHHSFDLWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 777 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPQAPLHPWGRGTMVTVSGGGGGSGGGGSGGGGSAFSSELTQDPAVSVALGQTVRVTCQGDSLRSYYASWYQQKPGQAPVLVIYGKNNRPSGIPDRFSGSSTADTASLTITGAQPEDEADYYCSSRHSSGSHRVFVGGTDQTVLG

SEQ ID NO: 778 - protein, 250 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAAYYCARSRDLLLFPHYPLLFWGRGTMVTVSSGGGGSGGGGSGGGGSAFSSELTQDPAVSVALGQTVRVTCQGDSLRRYYASWYQQKPGQAPVLVIYGKNNRPSGIPDRFSGFSSGNTASLHHNWGFRRKMRLTITVTPGTAVVTHGLFGGGTELTVLG

SEQ ID NO: 779 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRYLLLFPHHSFDLWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 780 - protein, 249 aa, Homo sapiens
QVQLQQSGAEVKKPGSSVRVSCKASGGTFNNDAINWVRQAPGQGLEWMGGIIPMFGTAKYSQNFQGRVAITADESTSTASMELSSLRSEDTAVYYCARSRDLLLFPRAPLYPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 781 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPKAPLDFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 782 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTVAYYCARSRYLLLFPQHGFDAWGRWTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCSSRDSSGNHWVFGGGTELTVLG

SEQ ID NO: 783 - protein, 249 aa, Homo sapiens
QVQLQQSGAEVKKPGSSVRVSCKASGGTFNNNAINWVRQAPGQGLEWMGGIIPMLGTAKYSQNFQGRVAITADESTGTASMELSSLRSEDTAVYYCARSRDLLLFPSAPLWPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 784 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPQEPLAPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 785 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHHPLEPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 786 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHHGFDAWGRGTMVTVSSGGGGSGGGGSGGGGSAFSSELTQDPAVSVALGQTVRVTCQGDSLRSYYASWYQQKPGQAPVLVSYGKINRPSGIPDRFSGSSSGNTASLTITGAQAEDEADYYCNSRDSSGNHWVFGGGTELTVLG

SEQ ID NO: 787 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHYPLLFWGRGTMVTVSSGGGGSGGGGSGGGGSAFSSELTQDPAVSVALGQTVRVTCQGDSLRRYYASWYQQKPGQAPVLVIYGNNNRPSGIPDRFSGSSSGNTASLTITGAQAEDEADYYCNSRDSSGSHWVFGGGTELTVLG

SEQ ID NO: 788 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHYSLLLWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGSHWVFGGGTELTVLG

SEQ ID NO: 789 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHHPLQFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRGSSGNHWVFGGGTELTVLG

SEQ ID NO: 790 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHYPLLFWGRGTMVTVSSGGGGSGGGGSGGGGSAFSSELTQDPAVSVALGQTVRVTCQGDSLRRYYASWYQQKPGQAPVHVIYGKNNRPSGIPDRFSGSSSGNTASLTITGAQAEDEADYYCNSRDSSGSHWVFGGGTELTVLG

SEQ ID NO: 791 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHYPLLFWGRGTMVTVSSGGGGSGGGGSGGGGSAFSSELTQDPAVSVALGQTVRVTCQGDSLRRYYASWYQQKPGQAPVLVIYGKNNRPSGIPDRFSGSSSGNTASLTITGAQAEDEADYYCNCRDSSGSHWVFGGGTELTVLG

SEQ ID NO: 792 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHHSFDLWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNAASLTITGAQAEDEADYYCNSRDSSGNHWVFGGGTELTVLG

SEQ ID NO: 793 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHYTLLFWGRGTMVTVSSGGGGSGGGGSGGGGSAFSSELTQDPAVSVALGQTVRVTCQGDSLRRYYASWYQQKPGQAPVLVIYGKNNRPSGIPDRFSGSSSGNTASLTITGAQAEDEADYYCNSRDSSGSHWVFGGGTELTVLG

SEQ ID NO: 794 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHHGFDAWGRGTMVTVSSGGGGSGGGGSGGGGSAFSSELTQDPAVSVALGQTVRVTCQGDSLRSYYASWYQQKPGQAPVLVSYGKNNRPSGIPDRFSGSSSGNTASLTITGAQAEDEADYYCNSRDSSGNHWVFGGGTELTVLG

SEQ ID NO: 795 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPQAPLHPWGRGTMVTVSGGGGGSGGGGSGGGGSAFSSELTQDPAVSVALGQTVRVTCQGDSLRRYYASWYQQKPGQAPVLVIYGKNNRPSGIPDRFSGSSSGNTASLTITGAQAEDEADYYCNSRDSSGNHWVFGGGTELTVLG

SEQ ID NO: 796 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHYGMDVWGRGTMVTVSSGGGGSGGGGSGGGGSAFSSELTQAPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 797 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHHSFDLWGRGTMVTVSSGGGGSGGGGSGGGGSAFSSELTQDPAVSVALGQTVRVTCQGDSLRSYYASWYQQKPGQAPVLVIYGKNNRPSGIPVRFSGSSSGTAASLTITGAQAEDEADYYCNSRDSSGNHWVFGGGTELTVLG

SEQ ID NO: 798 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHYSLVLWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGSHWVFGGGTELTVLG

SEQ ID NO: 799 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPQEPLSPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDRSGNHWVFGGGTELTVLG

SEQ ID NO: 800 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPQESFSLWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 801 - protein, 249 aa, Homo sapiens
QVQLQQPGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPKAPLTFWGRGTMVTVSSGGGGSGGGGSGGGGSAFSSELTQDRAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 802 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTAFMELSSLRSEDTAVYYCARSRDLLLFPHDSFFLWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 803 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELISLRSEDTAVYYCARSRDLLLFPHHSFDLWGRGTMVTVSSGGGGSGGGGSGGGGSAFSSELTQDRAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 804 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHHALDVWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 805 - protein, 249 aa, Homo sapiens
QVQLQQSGAEVKKPGSSVRVSCKASGGTFNNNAINWVRQAPGQGLEWMGGIIPMFGTAQYSQNFQGRVAITADESTSTASMELSSLRSEDTAVYYCARSRDLLLFPHHSFDLWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 806 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRYLLLFPDHSFDLWGRGTMCTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 807 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHYPLLFWGRGTMVTVSSGGGGSGGGGSGGGGSAFSSELTQDPAVSVALGQTVRVTCQGDSLRRYYASWYQQKPGQAPVLVIYGKSNRPSGIPDRFSGSSSGNTASLTITGAQAEDEADYYCNSRDSSGSHWVFGGGTELTVLG

SEQ ID NO: 808 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHHSFDLWGRGTMVTVSSGGGGSGGGGSGGGGSAFSSELTQDPAVSVALGQTVRVTCQGDSLRSYYASWYQQKPGQAPVLVIYGKNSRPSGIPDRFSGSSSGNTASLTITGAQAEDEADYYCNSRDSSGNHWVFGGGTELTVLG

SEQ ID NO: 809 - protein, 249 aa, Homo sapiens
QVQLQQSGAEVKKPGSSVRVSCKASGGTFNNDAINWVRQAPGQGLEWMGGIIPMFGTAKYSQNFQGRVAITADESTSTASMELSSLRSEDTAVYYCARSRDLLLFPRAPLYPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNYRDSSGNHWVFGGGTELTVLG

SEQ ID NO: 810 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRYLLLFPHHSFDLWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNAASLTITGAQAEDEADYYCNSRDSSGNHWVFGGGTELTVLG

SEQ ID NO: 811 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHHSFDLWGRGTMVTVSSGGGGSGGGGSGGGGSAFSSELTQDPAVSVALGQTVRVTCQGDSLRSYYASWYQQKPGQAPVLVIYGKSNRPSGIPDRFSGSSSGNTASLTITGAQAEDEADYYCNSRDSSGNHWVFGGGTELTVLG

SEQ ID NO: 812 - protein, 249 aa, Homo sapiens
QVQLQQSGSEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHHSFDTWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 813 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTDYMELSSLRSEDTAVYYCARSRDLLLFPHYPLLFWGRGTMVTVSSGGGGSGGGGSGGGGSAFSSELTQDPAVSVALGQTVRVTCQGDSLRRYYASWYQQKPGQAPVLVIYGKNNRPSGIPDRFSGSSSGNTASLTITGAQAEDEADYYCNSRDSSGSHWVFGGGTELTVLG

SEQ ID NO: 814 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHHRFDLWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 815 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRYLLLFPHYGMDVWGRWTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 816 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRYLLLFPHYPLLFWGRGTMVTVSSGGGGSGGGGSGGGGSAFSSELTQDPAVSVALGQTVRVTCQGDSLRRYYASWYQQKPGQAPVLVIYGKNNRPSGIPDRFSGSSSGNTASLTITGAQAEDEADYYCNSRDSSGSHWVFGGGTELTVLG

SEQ ID NO: 817 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRYLLLFPHHSFDLWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNAASLTITGAQAEDEADYYCNCRDSSGNHWVFGGGTELTVLG

SEQ ID NO: 818 - protein, 249 aa, Homo sapiens
QVQLQQSGAEVNKPGSSVRVSCKASGGTFNNNAINWVRQAPGQGLEWMGGIIPMFGTAQYSQNFQGRVEITADESTSTASMELSSLRSDDTAVYYCARSRDLLLFPHHRFDLWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 819 - protein, 249 aa, Homo sapiens
QVQLQQSGAEVKKPGSSPRVSCKASGGTFNNNAINWVRQAPGQGLEWMGGIIPMYGTAKYSQNFQGRVAITEHESTSTASMELSNLRSEDTAVYYCARSRDLLLFPHYPLLFWGRGTMVTVSSGGGGSGGGGSGGGGSAFSSELTQDPAVSVALGQTVRVTCQGDSLRRYYASWYQQKPGQAPVLVIYGKNNRPSGIPDRFSGSSSGNTASLTITGAQAEDEADYYCNSRDSSGSHWVFGGGTELTVLG

SEQ ID NO: 820 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHDSFDLWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 821 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHANLSPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 822 - protein, 249 aa, Homo sapiens
QVQLQQSGAEVKKPGSSVRVSCKASGGTFNNNAINWVRQAPGQGLEWMGGIIPMFVTAKYSQNFQGRVAITEDESTSTASMELSSLRSEDTAVYYCARSRDLLLFPHYPLLFWGRGTMVTVSSGGGGSGGGGSGGGGSAFSSELTQDPAVSVALGQTVRVTCQGDSLRRYYASWYQQKPGQAPVLVIYGKNNRPSGIPDRFSGSSSGNTASLTITGAQAEDEADYYCNSRDSSGSHWVFGGGTELTVLG

SEQ ID NO: 823 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTDSMELSSLRSEDTAVYYCARSRDLLLFPHHRFDLWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 824 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPYEPLRFWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNRWVFGGGTELTVLG

SEQ ID NO: 825 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHHSFDLWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGSHWVFGGGTELTVLG

SEQ ID NO: 826 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHHSFDLWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNAASLTITGAQAEDEADYYCNFRDSSGNHWVFGGGTELTVLG

SEQ ID NO: 827 - protein, 249 aa, Homo sapiens
QVQLQQSGAEVKKPGSSVRVSCKASGGTFNNNAINWVRQAPGQGLEWMGGIIPMFGTAQYSQNFQGRVAITADESTSTASMELSSLRSEDTAVYYCARSRDLLLFPHYPLLFWGRGTMVTVSSGGGGSGGGGSGGGGSAFSSELTQDPAVSVALGQTVRVTCQGDSLRRYYASWYQQKPGQAPVLVIYGKINRPSGIPDRFSGSSSGNTASLTITGAQAEDEADYYCNSRDSSGSHWVFGGGTELTVLG

SEQ ID NO: 828 - protein, 249 aa, Homo sapiens
QVQLQQSGAEVKKPGSSVRVSCKASGGTFNNNAINWVRQAPGQGLEWMGGIIPMLGTAKYSQNFQGRVAITADESTSTASMELSSLRSEDTAVYYCARSRDLLLFPHHSFDLWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 829 - protein, 249 aa, Homo sapiens
QVQLQQSGAEVKKPGSSVRVSCKASGGTFNNNAINWVRQAPGQGLEWMGGIIPMFGTAMYSQNFQGRVAITADESTSTASMELSSLRSEDTAVYYCARSRDLLLFPHHRFDLWGRGTMGTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNYRDSSGNHWVFGGGTELTVLG

SEQ ID NO: 830 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHHSFDLWGRGTMGTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 831 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRYLLLFPHHSFDLWGRGTMGTVSSGGGGSGGGGSGGGGSAFSSELTQDPAVSVALGQTVRVTCQGDSLRSYYASWYQQKPGQAPVLVIYGKNKRPSGIPDRFSGSSSGNTASLTITGAQAEDEADYYCNSRDSSGNHWVFGGGTELTVLG

SEQ ID NO: 832 - protein, 249 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHYPLLFWGRGTMVTVSSGGGGSGGGGSGGGGSAFSSELTQDPAVSVALGQTVRVTCQGDSLRRYYASWYQQKPGQAPVLVIYGKNNRPSGIPDRFSGSSSGNTASLTITGAQAEDEADYYCNYRDSSGSHWVFGGGTELTVLG

SEQ ID NO: 833 - protein, 249 aa, Homo sapiens
QVQLQQSGAEVKKPGSSVRVSCKASGGTFNNNAINWVRQAPGQGLEWMGGIIPMFGTAKYSQNFQGRVAITVDESTSTASMELSSLRSEDTAVYYCARSRDLLLFPQAPLSPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCNSRDSSGNHWVFGGGTELTVLG

SEQ ID NO: 834 - protein, 250 aa, Homo sapiens
GVQLVQSGPEVKKPGASVKVSCTASGYTFTSYGVSWVRQAPGQGLEWIGWISAHNGQTKYAEKFQGRVTMTRNTSISTAYMELSSLRSEDTAVYYCARDGSYDILTGYYIDNYMDVWGKGTMVTVSSGGGGSGGGGSGGGGSSELTQDPAVSVALGQTVRITCQGDSLRSYYTNWFQQKPGQAPLLVVYAKNKRPSGIPDRFSGSSSGNTASLTITGAQAEDEADYYCHSRDSSGNHVLFGGGTKLTVLG

SEQ ID NO: 835 - protein, 248 aa, Homo sapiens
EVQLVESGGGVVQPGGSLRLSCAASGFTVNSYAMHWVRQAPGKGLQWVAVIPYDGSKKYYADSVKGRFTVSRDNSKNTLYLQMNSLRAEDTAVYYCARSHYDILTGLNYWYFDLWGRGTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRGSSGNHVVFGGGTKLTVLG

SEQ ID NO: 836 - protein, 253 aa, Homo sapiens
GVQLQQSGAEVKKPGSSVKVSCKASGGTFNTSGITWVRQAPGQGLEWMGWMNPNTGDTAYAQEFQGRVIMTRDTSISTAYMELSSLRSEDTAVYYCARDGSYDILTGYYIDNYMDVWGQGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 837 - protein, 250 aa, Homo sapiens
GVQLVQSGAEVKKPGASVKVSCKASGYTFTNYGITWVRQTPGQGLEWMGWISAYNGNRNYAQKLQGRVTMTTDTSTSTAYMELRSLRSDDTAVYYCVRDGIDILLVPAALMDVWGQGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 838 - protein, 254 aa, Homo sapiens
QVQLQQSGPGLVKPSQILSLTCAISGDSVASNGAAWNWIRQSPSRGLEWLGRTYYRSKWYVDYAVSVKSRITINPDTSKNQFSLQLNSVTPEDTAVYYCARDRYDILTGYYYYGMDVWGQGTMVTVSSGGGGSGGGGSGGGGSQSALTQPASVSGSRGQSITISCTGTTGDVGGYDYVSWYQQHPGKAPKLLIYGNSNRPSGVPDRFSASKSGNTASLTISGLQAEDEADYFCNTYAPPGIIMFGGGTKLTVLG

SEQ ID NO: 839 - protein, 256 aa, Homo sapiens
GVQLVQSGGGVVQPGGSLRLSCAASGFTFSSYGMHWVRQAPGKGLEWVAVISYDGSNKYYADSVKGRFTISRDNSKNTLYLQMNSLRAEDTAVYYCARDREAYYDILTGYYLYYYYMDVWGRGTTVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTGSTRVFGGGTKLTVLG

SEQ ID NO: 840 - protein, 251 aa, Homo sapiens
QVQLVQSGAEVMKPGASVKVSCKASGYNFNNYAMQWVRQAPGQRLEWMGWIVPGNGKTKYSQKFQDRVTIARDTSASTVYMELSSLTSEDTAMYYCARATYDPLTGYSFDGFDIWGQGTTVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 841 - protein, 255 aa, Homo sapiens
AVQLQESGPGLVKPSETLSLTCSVSGASMTTNKFYWSWIRQPPGKGLEWIGNINYSKSTNYNPSLKSRITISVDTSKNQLSLKLNSVTAADTAVYYCARHVRDYDILTGYYRGHYFDYWGQGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 842 - protein, 250 aa, Homo sapiens
QMQLVRSGGGVVQPGRSLRLSCAASGFTFSSYGMHWVRQAPGKGLEWVSVTYSGGNTNYADSVRGRFTISRDNSKNTLYLQMNSLRAEDTAVYYCAREGSYDILTGYYVGVGRMDVWGKGTLVTVSSGGGGSGGGGSGGGGSSELTQDPAVSVALGQTVRITCQGDSLRSYYTNWFQQKPGQAPLLVVYAKNKRPSGIPDRFSGSSSGNTASLTITGAQAEDEADYYCNSRDSSGNHVVFGGGTKLTVLG

SEQ ID NO: 843 - protein, 256 aa, Homo sapiens
QVQLVQSGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTFNPTYDILTGYYIGGYFQHWGQGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTQLTVLG

SEQ ID NO: 844 - protein, 254 aa, Homo sapiens
QVQLQESGPGVVKPSQTLSLTCTVSGVSISSDSYYWSWIRQPAGKGPEWIGRIYPTGSTNYNPSLKSRVTISVDTSKNQFSLQLTSVTAADTAVYYCARGRWDYDLLTGEHLGYYFDYWGRGTLVTVSSGGGGSGGGGSGGGGSALSSELTQDPAVSVALGQTVRITCQGDTLRNYYASWYQQKPGQAPVLVIHSRNNRPSGIPDRFSGSSSGTTASLTITGSQAEDEADYYCNSRDSSGNVIFGGGTKLTVLG

SEQ ID NO: 845 - protein, 251 aa, Homo sapiens
QVQLQQSGAEVKKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGKGTMVTVSSGGGGSGGGGSGGGGSQSALTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 846 - protein, 245 aa, Homo sapiens
GVQLVESGAEVKKPGASVKVSCRTSGYTFTSNSFSWVRQAPGQGLEWMGGIIPIFGTANYAQKLQGRVTITADELTRTVYMDLSSLRSEDTAVYYCATGMGDHYGMDVWGRGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 847 - protein, 251 aa, Homo sapiens
QVQLQQSGSELKKPGASVKVSCKVSGYSLTKMSMHWVRQSPGEGLEWVGGIDPETRQPVYAQKFQGRVTITKDTSASAAYMELSSLGSEDTALYYCARATYDPLTGYSFDGFDIWGQGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 848 - protein, 248 aa, Homo sapiens
GVQLVQSGAEVKKPGASVKVSCKASGYTFTHYAINWLRQAPGQRPEWMGTINTGNGNTKYSQNFQGRLTITRDTSASTVNMELSSLRSEDTAVYYCAGGYHDPLTSYNYNWFDPWGQGTMVTVSSGGGGSGGGGSGGGGSSELTQDPAVSVALGQTVRITCQGDSLRSYYTNWFQQKPGQAPLLVVYAKNKRPSGIPDRFSGSSSGNTASLTITGAQAEDEADYYCHSRDSSGNHVLFGGGTKLTVLG

SEQ ID NO: 849 - protein, 251 aa, Homo sapiens
QVQLQQSGSELKKPGASVIVSCKVSGYSLTKMSMHWVRQSPGEGLEWVGGIDPETRQPVYAQKFQGRVTITKDTSASAAYMELSSLGSEDTALYYCARATYDPLTGYSFDGFDIWGQGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 850 - protein, 250 aa, Homo sapiens
GVQLVQSGPEVKKPGASVKVSCTASGYTFTSYGVSWVRQAPGQGLEWIGWISAHNGQTKYAEKFQGRVTMTRNTSISTAYMELSSLRSEDTVVYYCARDGSYDILTGYYIDNYMDVWGKGTMVTVSSGGGGSGGGGSGGGGSSELTQDPAVSVALGQTVRITCQGDSLRSYYTNWFQQKPGQAPLLVVYAKNKRPSGIPDRFSGSSSGNTASLTITGAQAEDEADYYCHSRDSSGNHVLFGGGTKLTVLG

SEQ ID NO: 851 - protein, 250 aa, Homo sapiens
GVQLVQSGPEVKKPGASVIVSCTASGYTFTSYGVSWVRQAPGQGLEWIGWISAHNGQTKYAEKFQGRVTMTRNTSISTAYMELSSLRSEDTAVYYCARDGSYDILTGYYIDNYMDVWGKGTMVTVSSGGGGSGGGGSGGGGSSELTQDPAVSVALGQTVRITCQGDSLRSYYTNWFQQKPGQAPLLVVYAKNKRPSGIPDRFSGSSSGNTASLTITGAQAEDEADYYCHSRDSSGNHVLFGGGTKLTVLG

SEQ ID NO: 852 - protein, 251 aa, Homo sapiens
QVQLQQSGAEVKKPGASVNVSCKASGYTFTKYTMHWVRQAPGQGPEWMGWINGGSGDTKYSRKFQGRVTITKDTSASAAYMELSSLGSEDTALYYCARATYDPLTGYSFDGFDIWGQGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTILG

SEQ ID NO: 853 - protein, 251 aa, Homo sapiens
QVQLQQSGAEVKKPGASVKVSCKASGYTFTKYTMHWVRQAPGQGPEWMGWINGGSGDTKYSRKFQGRVTITKDTSASATYMELSSLGSEDTALYYCARATYDPLTGYSFDGFDIWGKGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 854 - protein, 253 aa, Homo sapiens
QVQQSGADVKKPGGSLRLSCAASGFTFSSYSMNWVRQAPGKGLEWVSSISSSSSYIYYADSVKGRFTISRDNAKNSLYLQMNSLRAEDTAVYYCAREGGNYDILTGYYIGNGAFDIWGRGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 855 - protein, 251 aa, Homo sapiens
QVQLVQSGAEVKKPGASVMVSCKASGYTFSTYAVHWVRQAPGQGLEWMGRINAGNGYTKYSQKFQGRVTITKDTSASAAYMELSSLGSEDTALYYCARATYDPLTGYSFDGLDIWGKGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 856 - protein, 251 aa, Homo sapiens
EVQLVQSGGEVKRPGASVKVSCKASGYTFSRYGISWVRQAPGQGLEWMGWISAYNGKTSFAEKFQGRVTLTTDTSTTTVDMELRNLRSDDTAVYYCARTDYDILTGYPMGYFDPWGKGTLVTVSSGGGGSGGGGSGGGGSALSSELTQDPAVSVALGQTVKITCQGDSLRSFYAAWYQQKPGQAPILVISGKNNRPSGIPDRFSGSSSGNTASLTITGAQAEDEADYYCNSRDTSGNHYVFGAGTKLTVLG

SEQ ID NO: 857 - protein, 255 aa, Homo sapiens
EVQLVQSGAEVKKPGASVKVFCKAFGYTFTSYYMHWVRQAPGQGLEWMGIINPSGGSTSYAQKFQGRVTMTRDTSTSTVYMELSSLRSEDTVVYYCARGGEYDILTGYYFGLGVYDYWGQGTMVTVSSGGGGSGGGGSGGGGSAQTVLTQTPSVSAAPGQKVTISCSGSISNIGNKYVSWYQQLPGTAPKLLIYDNDKRPSGIPDRFSGSKSGTSATLGITGLQTGDEADYYCGTWDSSLSAGVFGGGTKLTVLG

SEQ ID NO: 858 - protein, 253 aa, Homo sapiens
QVQLVESGGGLIQPGGSLRLSCAASGFSFGSYAMSWIRQAPGKGLEWVSTSTGRGGSTYYADSVKGRFTISRDNAKNSLYLQMNSLRAEDAAVYYCARGGDYDILTGLYYYGMDVWGKGTMVTVSSGGGGSGGGGSGGGGSSYVLTQPPSVSGTPGQRVTISCSGGRSNIGSNTVKWYQQLPGTAPKLLIYGNDQRPSGVPDRFSGSKSGTSASLAITGVQAEDEADYYCQSYDSSLRGSRVFGTGTKVTVLG

SEQ ID NO: 859 - protein, 250 aa, Homo sapiens
QVQLQQSGAEVKKPGSSVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGQGTLVTVSSGGGGSGGGGSGGGGSQSVLTQPASVSGSPGQSITISCTGTSSDVGGYNYVSWYQQHPGKAPKLMIYDVSKRPSGVPDRFSGSKSGNTASLTISGLQAEDEGDYYCSSYAGPSRVFGGGTKVEIKR

SEQ ID NO: 860 - protein, 253 aa, Homo sapiens
QVQLVQSRAEVKRPGASVKVSCKASGYRFGSYGITWVRQAPGQGLEWMGWISTRYGDTKSAQKVEGRVTLTTDTSTSTAYMELRSLRSDDTAVYYCARDGSYDILTGYYIDNYMDVWGRGTLVTVSSGGGGSGGGGSGGGGSQSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLG

SEQ ID NO: 861 - protein, 248 aa, Homo sapiens
QMQLVQSGAEVRKPGSSVKVSCKASGGSFSSHVFSWVRQAPGQGLEWVGGITPKFATPNYAQKFQHRVTITADELTRTVFMDLSGLRSEDTAVYYCARGYDSSAFRAFDIWGQGTLVTVSSGGGGSGGGGSGGGGSAQSVLTQPPSVSAAPGQKVTISCSGSSSNIGNNYVSWYQQFPGTAPKLLIYDNNNRPSGVPDRFSGSKSGTSATLGITGLQTGDEADYYCGTWDRSLSVVVFGGGTKVTVLG

SEQ ID NO: 862 - protein, 258 aa, Homo sapiens
EVQLVQSGAEVKKPGSSVKVSCRASGGSFIDGSINWLRQAPGQGLEWVGGTIPLANRANYAQKFRDRVTITADELTAIVFLELTSLRSDDTALYYCARSSPPRWYDALTGDSSYHSAMDVWGQGTMVTVSSGGGGSGGGGSGGGGSAQSALTQPPSASGSPGQSVTISCSGTSSDIGDSNSVSWYQQHPGKAPKLLIYEVTKRPSGVPDRFAGSRSDNTASLTVSGLQTEDEADYYCSSSAARNHLVFGGGTKVTVLG

SEQ ID NO: 863 - protein, 255 aa, Homo sapiens
QVQLVQSGAEVKKPGASVKVSCTVSGDSFSRHGISWVRQAPGQGLEWMGWISVYNGDTKYAQKVQGRVTMTTDTSTNTVYMELRRLRSDDTAVYYCARDEGRDLLTGYYWPNFFDSWGRGTLVTVSSGGGGSGGGGSGGGGSALSYVLTQPPSASGTPGQRVTISCSGSRPNIGGNTVNWYQQLPGAAPKLLIYSNSQRPSGVPDRFSGSKYGTSASLAISGLQSDDEADYYCAAWDDSLTGPVFGGGTKLTVLG

SEQ ID NO: 864 - protein, 259 aa, Homo sapiens
QVQLVQSGAEVKKPGSSVKVSCRASGGSFIDDSINWLRQAPGQGLEWVGGTIPLANRANYAQKFRDRATITADELTATVFLELTSLRSDDTALYYCARSSPPKWYDALTGHSSYHSAMDVWGRGTLVTVSSGGGGSGGGGSGGGGSAQSVLTQPPSASGTPGQRVTISCSGTNSNIGGNTVNWYQQLPGTAPRLLIYSNNQRPSGVPDRFSGSKSGTSASLAISGLQSEDEADYYCAARDDRLNAHVVFGGGTKVTVLG

SEQ ID NO: 865 - protein, 258 aa, Homo sapiens
QVQLVQSGAEVKKPGSSVKVSCRVSGGSFTDDSINWLRQAPGQGLEWVGGTIPLANRANYAQKFRDRVTITADELTATVFLELTSLRSDDTALYYCARSSPPKWYDALTGDSSYHSAMDVWGRGTLVTVSSGGGGSGGGGSGGGGSAQSVVTQPPSVSAAPGQKVTISCSGSTSNIGRNYVSWYQQLPGTATKLLIYDNNKRPSGIPDRFSGSKSGTSATLGITGLQTGDEADYYCGTWDSSLRIYVFGTGTKVTVLG

SEQ ID NO: 866 - protein, 255 aa, Homo sapiens
QVQLVQSGAEVKKPGASVKVSCTVSGDSFSRHGISWVRQAPGQGLEWMGWISVYNGDTKYAQKVQGRVTMTTDTSTNTVYMELRRLRSDDTAVYYCARDEGRDLLTGYYWPNFFDSWGRGTLVTVSSGGGGSGGGGSGGGGSALSYVLTQPPSVSGTPGQKVTISCSGSRPNIGGNTVNWYQQLPGAAPKLLIYSNSQRPSGVPDRFSGSKYGTSASLAISGLQSDDEADYYCAAWDDSLTGPVFGGGTKLTVLG

SEQ ID NO: 867 - protein, 250 aa, Homo sapiens
QVQLVQSGAEVKKPGASVKVSCKASGYTFTNYGITWVRQAPGQGLEWMGWISAYNGNRNYAQKLQGRVTMTTDTSTSTAYMELRSLRSDDTAVYYCVRDGIDILLVPAALMDVWGRGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 868 - protein, 250 aa, Homo sapiens
EVQLVQSGAEVKKPGASVKVSCKASGYTFTNYGITWVRQAPGQGLEWMGWISAYNGNRNYAQKLQGRVTMTTDTSTSTAYMELRSLRSDDTAVYYCVRDGIDILLVPAALMDVWGKGTLVTVSSGGGGSGGGGSGGGGSQSVLTQPASVSGSPGQSITISCTGTSSDVGGYNYVSWYQQHPGKAPKLMIYEGNKRPSGVSNRFSGSKSGNTASLTISGLQAEDEADYYCSSYTTRSTRVFGGGTKLTVLG

SEQ ID NO: 869 - protein, 257 aa, Homo sapiens
QVQLVQSGAEVKKPGASMKVSCKASAGRASAYGFAMHPIHWVRQAPGQGLEWMGWINGGTGNTKYSEKFLGRVTMTSDTSATTAYMELSSLRSEDTAVYYCARQDNDPLTGYKLGFDYWGKGTLVTVSSGGGGSGGGGSGGGGSAQSVVTQPPSVSGAPGQRVTISCTGSSTNVGAGYGVHWYQQFPETAPKLLIYGGSNRPSGVPDRFSGSQSGTSASLAITGLQAEDEADYYCQSYDTTLSGYVFGTGTKVTVLG

SEQ ID NO: 870 - protein, 254 aa, Homo sapiens
  Site (42): Xaa equals any of the naturally occurring L-amino acids
  Site (45): Xaa equals any of the naturally occurring L-amino acids
  Site (51): Xaa equals any of the naturally occurring L-amino acids
  Site (57): Xaa equals any of the naturally occurring L-amino acids
  Site (65): Xaa equals any of the naturally occurring L-amino acids
  Site (67): Xaa equals any of the naturally occurring L-amino acids
  Site (70): Xaa equals any of the naturally occurring L-amino acids
  Site (170): Xaa equals any of the naturally occurring L-amino acids
  Site (176): Xaa equals any of the naturally occurring L-amino acids
  Site (192): Xaa equals any of the naturally occurring L-amino acids
  Site (235): Xaa equals any of the naturally occurring L-amino acids
  Site (239): Xaa equals any of the naturally occurring L-amino acids
  Site (240): Xaa equals any of the naturally occurring L-amino acids
QVQLQQSGPGLVKPSQILSLTCAISGYSVASNGAAWNWIRQXPSXGLEWLXRTYYRXKWYVDYAXSXKRXITINPDTSKNQFSLQLNSVTPEDTVVYYWARDRYDILTGYYYYGMDVWGQGTMVTVSSGGGGSGGGGSGGGGSQSALTQPASVSGSRGQSITISCTGTTXDVGGYXYVSWYQQHPGKAPKLXIYGNSNRPSGVPDRFSASKSGNTASLTISGLQAEDEADYFCSXYAPXXIIMFGGGTKLTVLG

SEQ ID NO: 871 - protein, 251 aa, Homo sapiens
QVQLQQSGAEVKKTGASVKVSCKASGYIFADYYVHWVRQAAGQGLEWMGWINPNTGSTKYAQKFQDRVTMTRDTSIKTVYMELRRLRSDDTALYYCARATYDPLTGYSFDGFDIWGKGTMVTVSSGGGGSGGGGSGGGGSQSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLG

SEQ ID NO: 872 - protein, 256 aa, Homo sapiens
QVQLVQSGGGLVKPGGSLRLSCAASGFTFSNAWMSWVRQAPGKGLQWVGRIKSKTDGGTTDYAAPVKGRFTISRDDSKNTLYLQMNSLKTEDTAVYYCTTFNPTYDILTGYYIGGYFQHWGQGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTQLTVLG

SEQ ID NO: 873 - protein, 254 aa, Homo sapiens
QVQLQESGAEVKKSGESLKISCKASGYIFTDYWIGWVRQTPGKGLEWMGWINPNNGGTKYAQNFQGRVTMTRDTSVSTAYMELSRLRSDDTAVYYCARERHYYDILTGYQTGYGMDVWGRGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 874 - protein, 251 aa, Homo sapiens
QVQLQQSGAEVKKPGASVKVSCKASKYTFANHYIHWVRQAPGEGLEWMGNINPSGSSTRYAQRFQGRVTMTRDTSTSTVYMELSNLRSDDTAVYYCARATYDPLTGYSFDGFDIWGKGTLVTVSSGGGGSGGGGSGGGGSQSVLTQPASVSGSPGQSITISCTGTSSNVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 875 - protein, 251 aa, Homo sapiens
QVQLQQSGAEVKKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGQGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 876 - protein, 251 aa, Homo sapiens
QVQLQQSGAEVKKPGASVKVSCKASKYTFANHYIHWVRQAPGEGLEWMGNINPSGSSTRYAQRFQGRVTMTRDTSTSTVYMELSNLRSDDTAVYYCARATYDPLTGYSFDGFDIWGKGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 877 - protein, 248 aa, Homo sapiens
EVQLVQSGAEVKKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGKGTMVTVSSGGGGSGGGGSGGGGSSELTQDPAVSVALGQTVRITCQGDSLRSYYTNWFQQKPGQAPVLVIYGKNNRPSGIPDRFSGSSSGNTASLTITGAQAEDEADYYCNSRDSSGNHVVFGGGTKLTVLG

SEQ ID NO: 878 - protein, 247 aa, Homo sapiens
EVQLVQSGAEVKNPGSSVKVSCQASGGSFSRYAISWVRQAPGQGLEWMGRIIPIVATPNYAQRFQGRITISADTLTSTAFMELSSLRSEDTAVYYCARDRETKVGYGMDVWGRGTMVTVSSGGGGSGGGGSGGGGSQSVLTQPPSASGTPGQRVTISCSGSSSNIGSNTVNWYQRLPGAAPQLLIYNNDQRPSGIPDRFSGSKSGTSGSLVISGLQSEDEADYYCASWDDSPNGRVFGGGTKLTVLG

SEQ ID NO: 879 - protein, 251 aa, Homo sapiens
QVQLQQSGAEVKKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGQGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTILG

SEQ ID NO: 880 - protein, 253 aa, Homo sapiens
QVQQSGAEVKKPGGSLRLSCAASGFTFSSYSMNWVRQAPGKGLEWVSSISSSSSYIYYADSVKGRFTISRDNAKNSLYLQMNSLRAEDTAVYYCAREGGNYDILTGYYIGNGAFDIWGRGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 881 - protein, 254 aa, Homo sapiens
GVQLVQSGGGVVQPGRSLRVSCAASGFTFSSYAMHWVRQAPGKGLEWVAVLSYDGDNKYYADSVKGRFTISRDNSKNTLYLQMNSLRAEDTAVYYCAREGSYDILTGYYVGVGRMDVWGKGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 882 - protein, 251 aa, Homo sapiens
EVQLVQSGAEVKKPGASVKVSCKASDYLFTKYYVHWVRQAPGQGLEWMGWINGGSGDTKYSRKFQGRVTITKDTSASAAYMELSSLGSEDTALYYCARATYDPLTGYSFDGFDIWGKGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 883 - protein, 250 aa, Homo sapiens
GVQLVQSGGGLVQPGGSLRLSCAASGFTFRSYSMNWVRQAPGKGLEWVSSISSGGNIYYADSVRGRFTISRDNAKNSVYLQMNSLRAEDTAVYYCARDSYDILTGYRGYYFDYWGKGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 884 - protein, 251 aa, Homo sapiens
QVQLQQSGAEVKKPGASVKVSCKASGYTFTKYTMHWVRQAPGQGPEWMGWINGGSGDTKYSRKFQGRVTITKDTSASAVYMELSSLGSEDTALYYCARATYDPLTGYSFDGFDIWGRGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 885 - protein, 253 aa, Homo sapiens
  Site (214): Xaa equals any of the naturally occurring L-amino acids
QVQQSGAEVKKPGGSLRLSCAASGFTFSSYSMNWVRQAPGKGLEWVSSISSSSSYIYYADSVKGRFTISRDNAKNSLYLQMNSLRAEDTAVYYCAREGGNYDILTGYYIGNGAFDIWGRGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNXASLTISGLQAEDEADYYCSSYTTRSTRVFGGGTKLTVLG

SEQ ID NO: 886 - protein, 251 aa, Homo sapiens
QVQLQQSGAEVKKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGQGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 887 - protein, 251 aa, Homo sapiens
QVQLQQSGAEVKKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGRGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 888 - protein, 254 aa, Homo sapiens
QVQLQESGAEVKKSGESLKISCKASGYIFTDYWIGWVRQTPGKGLEWMGWINPNNGGTKYAQNFQGRVTMTRDTSVSTAYMELSRLRSDDTAVYYCARERHYYDILTGYQTGYGMDVWGRGTMVTVSSGGGGSGGGGSGGGGSQSVLTQPASVSGSPGQSITISCTGTSSDVGGYNYVSWYHQHPGKAPKLMIYEGSKRPSGVSNRFSGSKSGNTASLTIFRLQAEDEADYYCSSHTTRSTRVFGGGTKLTVLG

SEQ ID NO: 889 - protein, 251 aa, Homo sapiens
QVQLQQSGAEVKKPGASVTVSCRASGYNFITYGIHWVRQAPGQGPEWMGWINPGSGNTGSSQKFNHRVTITRDTSATTAYMEMRSLRSEDTALYYCARATYDPLTGYSFDGFDIWGQGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 890 - protein, 251 aa, Homo sapiens
EVQLVQSGAEVKKPGSSVKVSCMASGGSFNHAISWVRQAPGRGLEWMGGILPMYGTANYAQKFQGRVTITADKLTNTVYMDLSRLRYEDTAVYYCARELGSSIVGATTGALDMWGRGTMVTVSSGGGGSGGGGSGGGGSAQAVVIQEPSFSVSPGGTVTITCGLTSGSVTTSYYPTWYQQAPGQAPRTLIYSTKIRSSGVPDRFSGSIIGNKAALTITGAQADDESDYYCLLYMGSGTRVFGGGTKLTVLG

SEQ ID NO: 891 - protein, 251 aa, Homo sapiens
VVQLVQSGAEVKKPGSSVKVFCMSSGGSFNHAISWVRQAPGRGLEWMGGILPMYGTANYAQKFQGRVTITADKLTNTVYMDLSRLRYEDTAVYYCARELGSSIVGATTGALDMWGRGTMVTVSSGGGGSGGGGSGGGGSAQAVVIQEPSFSVSPGGTVTITCGLTSGSVTTSYYPTWYQQAPGQAPRTLIYSTKIRSSGVPDRFSGSIIGNKAALTITGAQADDESDYYCLLYMGSGTRVFGGGTKLTVLG

SEQ ID NO: 892 - protein, 249 aa, Homo sapiens
QVHLRESGGGLVQPGGSLRLSCAASGFTFSSYGMHWVRQAPGKGLEWVAVISYDGSNKYYADSVKGRFTISRDNSKNTLYLQMNSLRAEDTAVYYCAKDGYYDILTGYSYYGMDVWGQGTLVTVSSGGGGSGGGGSGGGGSSELTQDPAVSVALGQTVRITCQGDSLRSYYTNWFQQKPGQAPLLVVYAKNKRPSGIPDRFSGSSSGNTASLTITGAQAEDEADYYCNSRDSSGNHVVFGGGTKLTVLG

SEQ ID NO: 893 - protein, 248 aa, Homo sapiens
QVQLVQSGAEVKKPGASVKVSCKASGYTFTSYGISWVRQAPGQGLEWMGWISAYNGNTNYAQKFQGRVTITADESTSTAYMELSSLRSEDTAVYYCARMEYDILTGYYGGYFDYWGQGTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 894 - protein, 251 aa, Homo sapiens
EVQLVQSGAEVKKPGSSVKVSCRASGGSFNHAISWVRQAPGRGLEWMGGILPMYGTANYAQKFQGRVTITADKLTNTVYMDLSRLRYEDTAVYYCARELGSSIVGATTGALDMWGRGTMVTVSSGGGGSGGGGSGGGGSAQAVVIQEPSFSVSPGGTVTITCGLTSGSVTTSYYPTWYQQAPGQAPRTLIYSTKIRSSGVPDRFSGSIIGNKAALTITGAQADDESDYYCLLYMGSGTRVFGGGTKLTVLG

SEQ ID NO: 895 - protein, 248 aa, Homo sapiens
VQLVQSGAEVKKPGSSVKVSCKASGGTFSSYAFNWVRRAPGQGLEWLGSIVPVFNTKTFARKFQGRVTLTADELTRTAYLELSNLRSDDTAVYYCASRYGDPFYYYYYMNVWGQGTLVTVSSGGGGSGGGGSGGGGSALSSELTQDPTVSVALGQTVSITCQGDSLRSYYATWYQQKPGQAPLLVLYGDNKRPSGIPGRFSGSTSGNTASLTITGAQAEDEADYYCNSRDSSGHQWLFGGGTKLTVLG

SEQ ID NO: 896 - protein, 249 aa, Homo sapiens
EVNLRESGGGVVQPGRSLRLSCAASGFTFSSYGMHWVRQAPGKGLEWVAGISYDGSNKYYAHSVKGRFTISRDNSKNTLYLQMNSLRAEDTAVYYCAKDGYYDILTGYSYYGMDVWGQGTMVTVSSGGGGSGGGGSGGGGSSELTQDPAVSVALGQTVRITCQGDSLRSYYTNWFQQKPGQAPVLVVYAKNKRPSGIPDRFSGSSSGNTASLTITGAQAEDEADYYCNSRDSSGNHVVFGGGTKLTVLG

SEQ ID NO: 897 - protein, 252 aa, Homo sapiens
QVQLVQSGAEVKKPGSSVKVSCRASGGSFNHAISWVRQAPGRGLEWMGGILPMYGTANYAQKFQGRVTITADKLTNTVYMDLSRLRYEDTAVYYCARELGLSIVGATTGALDMWGKGTLVTVSSGGGGSGGGGSGGGGSALSYVLTQPPSASGTPGQRVTISCSGSSSNIGNNYVFWYQQLPGAAPKLLIYRNSQRPSGVPDRFSGSTSGTSASLAISGLRSEDEADYYCAARDDSLRGPVFGGGTKLTVLG

SEQ ID NO: 898 - protein, 252 aa, Homo sapiens
EVQLVQSGAEVKKPGSSVKVSCQASGGNFNSYGVSWVRQAPGQGLEWMGRIIPNVGTANYAQKFQGRVTITADKLTSTVYLEVRSLRSEDTAVYYCARGDYDILTGYPAECFQIWGQGTMVTVSSGGGGSGGGGSGGGGSAQAVLTQPSSASGTPGQRVTISCSGSTSNIGTNTVNWYQQLPGTAPKLLIYSNHLRPSGVPDRFSGSKSGTSASLAISGLQSEDEADYYCSARDDSLNGVVFGGGTKVTVLG

SEQ ID NO: 899 - protein, 250 aa, Homo sapiens
QVQLVQSGAEVKKPGSSVKVSCQASGGNFNSYGVSWVRQAPGQGLEWMGRIIPNVGTANYAQKFQGRVTITADKLTSTVYLEVRSLRSEDTAVYYCARGDYDILTGYPAECFQIWGRGTLVTVSSGGGGSGGGGSGGGGSALPVLTQPPSVSVSPGQTATITCSGDELGRKYVSWYQQKPGQSPLLVIYQDSKRPSGIPERFSASNSGNTATLTISGTQPMDEADYYCQARDTTTAFSVFGTGTKVTVLG

SEQ ID NO: 900 - protein, 248 aa, Homo sapiens
HVQLVQSGAEVKKPGASVKVSCFASGYTFTSYGISWVRQAPGQGLEWMGWISAYNGNTNYAQKFQGRVTITADESTSTAYMELSSLRSEDTAVYYCARMEYDILTGYYGGYFDYWGQGTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 901 - protein, 250 aa, Homo sapiens
HVQLVQSGAEVKKPGSSVKVSCKSSGGTFSSYAFNWVRRAPGQGLEWLGSIVPVFNTKTFARKFQGRVTLTADELTRTAYLELSNLRSDDTAVYYCASRYGDPFYYYYYMNVWGRGTLVTVSSGGGGSGGGGSGGGGSAQSVLTQPPSASGTPGQRVTISCSGSRSSIGSNTVNWYQQFPGTAPKLLIYGDDQRPSGVPDRFSGSKSGTSASLAISGLQSEDEADYHCAAWDDSLSGYVFGTGTKLTVLG

SEQ ID NO: 902 - protein, 253 aa, Homo sapiens
  Site (199): Xaa equals any of the naturally occurring L-amino acids
  Site (203): Xaa equals any of the naturally occurring L-amino acids
QVQLVQSGAEVKKPGSSVKVSCQASGGNFNSYGVSWVRQAPGQGLEWMGRIIPNVGTTNYAQKFQGRVTITADKLTSTVYLEVRRLRSEDTAVYYCARGDYDILTGYPAECFQIWGKGTMVTVSSGGGGSGGGGSGGGGSAQAVLTQPSSASGTPGQRVTISCSGTSSNIGGNSVSWYQHLPGTAPKLLIYSNNRRPSXVPDXFSGSKSGTSASLAISGLQSGDEADYYCATWDDSLNGRVVFGGGTQLTVLS

SEQ ID NO: 903 - protein, 251 aa, Homo sapiens
EVQLVQSGAEVKKPGSSVKVSCRAYGGSFNHAISWVRQAPGRGLEWMGGILPMYGTANYAQKFQGRVTITADKLTNTVYMDLSRLRYEDTAVYYCARELGSSIVGATTGALDMWGRGTMVTVSSGGGGSGGGGSGGGGSAQAVVIQEPSFSVSPGGTVTITCGLTSGSVTTSYYPTWYQQAPGQAPRTLIYSTKIRSSGVPDRFSGSIIGNKAALTITGAQADDESDYYCLLYMGSGTRVFGGGTKLTVLG

SEQ ID NO: 904 - protein, 251 aa, Homo sapiens
EVQLVQSGAEVKKPGSSVKVSCKASGGTFSSYAFNWVRRAPGQGLEWLGSIVPVFNTKTFARKFQGRVTLTADELTRTAYLELSNLRSDDTAVYYCASRYGDPFYYYYYMNVWGQGTLVTVSSGGGGSGGGGSGGGGSAQAVLTQPSSVSGAPGQRVTISCTGSSSNIGAGYDVHWYQQLPGTAPKLLIYGNSNRPSGVPDRFSGSKSGTSASLAITGLQAEDEADYYCQSYDSSLSGWVFGGGTKLTVLG

SEQ ID NO: 905 - protein, 254 aa, Homo sapiens
EVQLVQSGAEVKKPGASVKVSCEASAELFASSDINWVRQATGQGLEWMGWVNPSSGNAGYAEKFEGRVIMTTNIPKKTVYMELSSLTSEDTAVYYCARGTGYDILTGYYMGSAFDQWGRGTMVTVSSGGGGSGGGGSGGGGSALEIVMTQSPGTLSLSPGERATLSCRASQSIRSNYLAWYQQKSGQAPRLLIYDVSSRATGIPDRFSGSGSGTDFTLTISRLEPEDFAVYYCQEYGFSLPNTFGQGTRLEIKR

SEQ ID NO: 906 - protein, 255 aa, Homo sapiens
EVQLVQSGADVKKPGASVKVSCKASGYNFMNYDINWVRQAPGEGLEWMGWMNPKSGKTDSAEKFEGRVTMTTDTSRDTVYMELSRLRSDDTAVYFCARGSGYDLLTGYFTGSPLDYWGRGTLVTVSSGGGGSGGGGSGGGGSAQSALTQPASVSGSPGQSITISCTGTSSDVGANNYVSWYQQHPGKAPKLMIFDVYTRPSGVASRFSGSKSANTASLTISGLQAEDEADYYCSSYSTNTMSHVFGTGTKLTVLG

SEQ ID NO: 907 - protein, 256 aa, Homo sapiens
EVQLVETGGGVVQPGGSLRLSCVGSGFTFSSYGMHWVRQAPGKGLEWMAVISSDGTKRYYADSVQGRLTISRDNFVKTLSLEMHSLRAEDTAVYYCAKDRGGNYDILTGYYFHHGVDVWGQGTLVTVSSGGGGSGGGGSGGGGSAQSALTQPASVSGSPGQSITISCTGTSSDVGRYNYVSWYRQYPGEAPKLMIYGVINRPSGVSSRFSGSKSGNTASLTISGLQAEDEADYFCSSYAGRSTYVFGTGTKVTVLG

SEQ ID NO: 908 - protein, 251 aa, Homo sapiens
QVQLVQSGGGLVQPGGPLRLSCAASGFTFSSYAMSWVRQAPGKGLEWVSAISGSGGSTYYADSVKGRFTISRDNSKNTLYLQMNSLRAEDTAVYYCARDAQSYYDILTGYQSYAFDIWGRGTTVTVSSGGGGSGGGGSGGGGSSELTQDPAVSVALGQTVRITCQGDSLRSYYTNWFQQKPGQAPLLVVYAKNKRPSGIPDRFSGSSSGNTASLTITGAQAEDEADYYCHSRDSSGNHVLFGGGTKLTVLG

SEQ ID NO: 909 - protein, 253 aa, Homo sapiens
EVQLVQSGAEVKKPGSPVRVSCKASGGTFTRYAISWVRQAPGQGLEWMGRIIPILGIANYAQKFQGRVTITADKLTSTVYMELSSLRSEDTAVYYCARDNYDILTGYSRRFDPWGQGTLVTVSSGGGGSGGGGSGGGGSALNFMLTQPHSVSESPGKTVTISCTRSSGNIASKYVQWYQQRPGSAPTTVIYENNRRPSGVPDRFSGSIDSSSNSASLTISGLKTEDEADYYCQSYDTSALYVFGTGTKLTVLG

SEQ ID NO: 910 - protein, 251 aa, Homo sapiens
VVQLVQSGAEVKKPGSSVKVSCRSSGGSFNHAISWVRQAPGRGLEWMGGILPMYGTANYAQKFQGRVTITADKLTNTVYMDLSRLRYEDTAVYYCARELGSSIVGATTGALDMWGRGTMVTVSSGGGGSGGGGSGGGGSAQAVVIQEPSFSVSPGGTVTITCGLTSGSVTTSYYPTWYQQAPGQAPRTLIYSTKIRSSGVPDRFSGSIIGNKAALTITGAQADDESDYYCLLYMGSGTRVFGGGTKLTVLG

SEQ ID NO: 911 - protein, 249 aa, Homo sapiens
DVNLRESGGGVVQPGRSLRLSCAASGFTFSSYGMHWVRQAPGKGLEWVAVISYDGSNKYYADSVKGRFTISRDNSKNTLYLQMNSLRAEDTAVYYCAKDGYYDILTGYSYYGMDVWGQGTMVTVSSGGGGSGGGGSGGGGSSELTQDPAVSVALGQTVRITCQGDSLRSYYTNWFQQKPGQAPLLVVYAKNKRPSGIPDRFSGSSSGNTASLTITGAQAEDEADYYCNSRDSSGNHVVFGGGTKLTVLG

SEQ ID NO: 912 - protein, 249 aa, Homo sapiens
KVQLVESGGGVVQPGRSLRLSCAASGFTFSSYGMHWVRQAPGKGLEWVALIWYDGSKKYYADSVKGRFTVSRDNSKNTLYLQMNSLRAEDTAVYYCARSHYDILTGLNYWYFDLWGRGTMVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSSTHRGVFGGGTKLTVLG

SEQ ID NO: 913 - protein, 248 aa, Homo sapiens
EVQLVESGGGLVQPGGSLRLSCAAFGFTFSSYSMNWVRQAPGKGLEWVSSISNRGSYIYYADSVKGRFTISRDNAKNTLYLQMNSLRAEDTAVYYCAREGRDILTGVYYYGLDVWGQGTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 914 - protein, 248 aa, Homo sapiens
DVQLVESGGGVVQPGGSLRLSCAASGFTVNSYAMHWVRQAPGKGLQWVAVISYDGSKKYYADSVKGRFTVSRDNSKNTLYLQMNSLRAEDTAVYYCARSHYDILTGLNYWYFDLWGRGTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRGSSGNHVVFGGGTKLTVLG

SEQ ID NO: 915 - protein, 247 aa, Homo sapiens
QVQLVQSGGGLIQPGGSLRLSCAASGFTVSSNYMSWVRQAPGKGLEWVSVVYADGRTYYADSVKGRFTISRDNSRNTLYLQMNSLRAEDTAVYYCARTYYDILTGRFFDIWGRGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTKSTRVFGGGTKLTVLG

SEQ ID NO: 916 - protein, 248 aa, Homo sapiens
DVQLVESGGGVVQPGGSLRLSCAASGFTVNSYAMHWVRQAPGKGLQWVAVISYDGSKKYYADSVKGRFTVSRDNSKNTLYLQMNSLRAEDTAVYYCARSHYDILTGLNYWYFDLWGRGTTVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYKCNSRDSSGNHVVFGGGTKLTVLG

SEQ ID NO: 917 - protein, 251 aa, Homo sapiens
VVQLVESGGGLVQPGRSLRLFCAVSGFTFSSYAMTWVRQAPGRGLEWVATISDSADRKYYADSVKGRFTIFRDNSRNMLYLQMNSLRAEDTAVYYCARDLRYDILTGYHDAFDIWGQGTMVTVSSGGGGSGGGGSGGGGSQSVLTQPPSASGSPGQSVTISCTGTSSDVGGYNYVSWYQQHPGKAPKFMIYDVSKRPSGVSNRFSGSKSGNTASLTISGVQAEDEADYYCSSYTSASTVIFGGGTKLTVLG

SEQ ID NO: 918 - protein, 249 aa, Homo sapiens
QVQLVQSGAEVKKPGSSVKVSCKVTGYTFRTSGITWVRQAPGQGLEWMGIINPSGGSTNYAQKFQGRVTMTRDTSTSTVYMELSSLRSEDTAVYYCARGAYYDILTGYYPYGMDVWGQGTLVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKR

SEQ ID NO: 919 - protein, 249 aa, Homo sapiens
QVQLLQSAAEVKKPGSSVKVSCKVSGGTFSSYAISWVRQAPGQGLEWMGWMNPNSGNTGYAQKFQGRVTMTRNTSISTAYMELSSLRSEDTAVYYCARGTYYDILTGYFHYGMDVWGQGTTVTVSSGGGGSGGGGSGGGGSDVVMTQSPSSVSASVGDRVTITCRASQGISSYLAWYQQKPGKAPKLLIYKASSLASGAPSRFSGSGSGTDFTLTISSLQPDDFATYYCQQYSNYPLTFGGGTKLEIKR

SEQ ID NO: 920 - protein, 248 aa, Homo sapiens
QVQLVQSGGGLVQPGRSLRLSCTASGFNFGDYAMGWVRQVPGKGLEWVAATSYNGSKKYYADSVKGRFTVSRDNSKNTLYLQMNSLRAEDTAVYYCARSHYDILTGLNYWYFDLWGRGTMVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 921 - protein, 248 aa, Homo sapiens
QVQLVQSGGGVVQPGGSLRLSCAASGFTFSSYAMSWVRQAPGKGLEWVSAISGSGGSTYYADSVKGRFTISRDNSKNTLYLQMNSLRAEDTAVYYCARDQHDILTGVYYGMDVWGKGTMVTVSSGGGGSGGGGSGGGGSALSSELTQDPAVSVALGQTVRITCQGDGLRNYYANWYQQKPGQAPVLVIYGKNNRPSGIPDRFSGSSSGNTASLTITGARAEDEGVYYCNSRDSSGAVFGGGTKLTVLG

SEQ ID NO: 922 - protein, 251 aa, Homo sapiens
QVQLVQSGGGVVQPGRSLRLSCAASGFNFNDYGMHWVRQAPGKGLEWVSGISWNSGTIGYAESVKGRFTISRDNAKNSLSLQMNSLRAEDTAVYYCARVSPSYDILTGYYLPHAFDVWGKGTLVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKR

SEQ ID NO: 923 - protein, 247 aa, Homo sapiens
QVQLVQSGGGLIQPGGSLRLFCAASGFTVSSNYMSWVRQAPGKGLEWVSVVYADGRTYYADSVKGRFTISRDNSRNTLYLQMNSLRAEDTAVYYCARTYYDILTGRFFDIWGRGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTKSTRVFGGGTKLTVLG

SEQ ID NO: 924 - protein, 247 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARPSYDILTGYLYYFDYWGQGTLVTVSSGGGGSGGGGSGGGGSSELTQDPAVSVALGQTVRITCQGDSLRSYYASWYQQKPGQAPVPVIYGKNNRPSGIPDRFSGSSSGNTASLTITGAQAEDEADYYCNSRDSSGNHVVFGGGTKLTVLG

SEQ ID NO: 925 - protein, 251 aa, Homo sapiens
EVQLVESGGGLVQPGRSLRLSCAASGFTFSSYAMTWVRQAPGRGLEWVATISDSADRKYYADSVKGRFTIFRDNSRNMLYLQMNSLRAEDTAVYYCARDLRYDILTGYHDAFDIWGQGTMVTVSSGGGGSGGGGSGGGGSQSVLTQPPSASGSPGQSVTISCTGTSSDVGGYNYVSWYQQHPGKAPKFMIYDVSKRPSGVSNRFSGSKSGNTASLTISGVQAEDEADYYCSSYTSASTVIFGGGTKLTVLG

SEQ ID NO: 926 - protein, 249 aa, Homo sapiens
QVQLVQSGAEVKKPGSSVKVSCKATGYTFRTSGITWVRQAPGQGLEWMGIINPSGGSTNYAQKFQGRVTMTRDTSTSTVYMELSSLRSEDTAVYYCARGAYYDILTGYYPYGMDVWGQGTLVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKR

SEQ ID NO: 927 - protein, 247 aa, Homo sapiens
QVQLVQSGAEVKKPGASVKVSCKASGYTFTSYGISWVRQAPGQGLEWMGWMNPNSGNTGYAQKFQGRVTMTRNTSTSTAYMELSSLRSEDTAVYYCARGQYYDILTGYNWFDPWGKGTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSQDSSGNHVVFGGGTKLTVLG

SEQ ID NO: 928 - protein, 246 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHYGMDVWGRGTMVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHAVFGGGTKLTVLG

SEQ ID NO: 929 - protein, 253 aa, Homo sapiens
QMQLVESAAVVKKPGSSVKVSCKASGRTFSSYAMSWVRQAPGQGLEWMGGIIPLTRKVNYAQKFQGRITLTADELTRVTYMELRSLRSDDTAVYYCARGGYSSGWLRGGPYNWFDPWGQGTLVTVSSGGGGSGGGGSGGGGSQSVLTQPPSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVIG

SEQ ID NO: 930 - protein, 251 aa, Homo sapiens
QVQLVQSAAEVKKPGASVKVSCKASGYTFTSYGISWVRQAPGQGLEWMGWISAYNGNTNYAQKFQGRVTITRDTSASTAYMELSSLRSEDTAVYYCARGDYDILTGYYIPLRDYWGQGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYATRSTRVFGGGTKLTVLG

SEQ ID NO: 931 - protein, 253 aa, Homo sapiens
QVQLQESGGGLVQPGRSLRLSCKTSGFSFGDHAMGWVRQAPGKGLEWIGYIRSKAYGGTTESAASVKGRFSISRDDSKSIAYLQMNSLKTEDTAVYYCSRNLFDVWTLPYYYYMDVWGRGTTVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 932 - protein, 250 aa, Homo sapiens
QVQLQQSGAEEKKPGASVKVSCKASGYTFTSYAMHWVRQAPGQRLEWMGWINAGNGNTKYSQKFQGRVAITRDTSASTAYMELSSLRSEDTAVYYCARADYDILTGYSPLTYGMDVWGRGTLVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKR

SEQ ID NO: 933 - protein, 250 aa, Homo sapiens
QVQLVQSGGGLVQPGGSLRLSCAASEFTVNNNYMNWVRQAPGKGLEWVGRIKSKTDGGTTDYAAPVKGRFTISRDDSKNTLYLQMNSLKTEDTAVYYCTTMYYDILTGHNFDYWGQGTMVTVSSGGGGSGGGGSGGGGSQSVLTQPASVSGSPGQSITISCIGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 934 - protein, 253 aa, Homo sapiens
QVQLVQSGAEVKKPGSSVKVSCKASGGTFSDSSISWVRQAPGQGLEWMGGIIPSFGTANYAQKFQGRVTITADESTSTAYMELSSLRSEDTAVYYCARVSRDILTGNYYYYGMDVWGRGTMVTVSSGGGGSGGGGSGGGGSSYVLTQPPSVSGTPGQRVTISCSGGRSNIGSNTVKWYQQLPGTAPKLLIYGNDQRPSGVPDRFSGSKSGTSASLAITGVQAEDEADYYCQSYDSSLRGSRVFGTGTKVTVLG

SEQ ID NO: 935 - protein, 253 aa, Homo sapiens
QMQLVESAAVVKKPGSSVKVSCKASGRTFSSYAMSWVRQAPGQGLEWMGGIIPLTRKVNYAQKFQGRITLTADELTRVTYMELRSLRSDDTAVYYCARGGYSSGWLRGGPYNWFDPWGQGTLVTVSSGGGGSGGGGSGGGGSQSVLTQPPSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLG

SEQ ID NO: 936 - protein, 253 aa, Homo sapiens
QVQLVQSGGGLVKPGRSLRLSCTASGFTFGDYAMSWFRQAPGKGLEWVGFIRSKAYGGTTEYAASVKGRFTISRDDSKSIAYLQMNSLKTEDTAVYYCTRAGGYYDILTGRDYYYGMDVWGQGTMVTVSSGGGGSGGGGSGGGGSDVVMTQSPSFLSAFVGDTITITCRASQGIYNYLAWYQQKPGKAPKLLIYAASTLQSGVPSRFSGSGSGTEFTLTISSLQPEDFGTYYCQQLISYPLTFGGGTKVEIKR

SEQ ID NO: 937 - protein, 239 aa, Homo sapiens
EVQLVESGGGVVRPGGSLRLSCAASGFTFDDYGMSWVRQAPGKGLEWVSGINWNGGSTGYADSVKGRFTISRDNAKNSLYLQMNSLRAEDTAVYYCARRRYALDYWGQGTLVTVSRGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 938 - protein, 253 aa, Homo sapiens
QVNLRESGGGLVQPGGSLRLSCAASGITFSSDDMSWVRQAPGKGLEWVSAIGRSRSTYYADSVKGRFTISRDNSKNTLYLQMNSLRAEDTAVYYCARDRGSYDILTGYYTPPHYYGMDVWGRGTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 939 - protein, 253 aa, Homo sapiens
QMQLVESAAVVKKPGSSVKVSCKASGRSFSSYAMSWVRQAPGQGLEWMGGIIPLTRKVNYAQKFQGRITLTADELTRVTYMELRSLRSDDTAVYYCARGGYSSGWLRGGPYNWFDPWGQGTLVTVSSGGGGSGGGGSGGGGSQSVLTQPPSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLG

SEQ ID NO: 940 - protein, 251 aa, Homo sapiens
QVQLQQSGAEVKKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGKGTLVTVSSGGGGSGGGGSGGGGSQSVLTQPASVSGSPGQSITISCTGTSSDVGGYNYISWYQQHPGKAPKLMIYEGSKRPSGVSNRFSGSKSGNTASLTISGLQAEDEADYYCSSYTTRSTRVFGGGTKLTVLG

SEQ ID NO: 941 - protein, 249 aa, Homo sapiens
EVQLVQSGGVVVQPGGSLRLSCAASGFTFDDYAMHWVRQAPGKGLEWVSLISWDGGSTYYADSVKGRFTVSRDNSKKTLYLQMNSLRAEDTAVYYCARSHYDILTGLNYWYFDYWGQGTTVTVGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 942 - protein, 250 aa, Homo sapiens
QVQLQQSRAEVKKPGSSVKVSCKASGGTFSSYAISWVRQAPGQGLEWMGRIIPIVNMANYAQKFQGRVTLTADKSTGTAYMELTSLRSEDTAVYYCARENYDFLTGYYGAFDIWGKGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCNSYTTRSTRVFGGGTKLTVLG

SEQ ID NO: 943 - protein, 251 aa, Homo sapiens
EVQLVESGGGLVKPGGSLRLSCTASGFTFGNAWMTWVRQAPGKGLEWVARIKSKTSDGTTDYAAPVKGRFTISRDDSKNTLYLQMSSLKTEDTAVYYCTTGIYDILTGYHWDGAFDIWGRGTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVLFGGGTKLTVLG

SEQ ID NO: 944 - protein, 251 aa, Homo sapiens
EVQLVQSGAEVKKPGASVKVSCKASGYTFTKYTMHWVRQAPGQEPEWMGWINGGSGDTKYSRKFQGRVTITKDTSASAAYMELSSLGSEDTALYYCARATYDPLTGYSFDGFDIWGQGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 945 - protein, 251 aa, Homo sapiens
EVQLVQSGAEVKKPGASVTVSCKTSGYTFKDYYMHWVRQAPGQGLEWMGVINPNGISTNYAQKFQGRVTMTRDMSTSTVYMELSSLRSEDTAVFYCARATYDPLTGYSFDGFDIWGKGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCYSYTTRSTRVFGGGTKLTVLG

SEQ ID NO: 946 - protein, 249 aa, Homo sapiens
QVQLQQWGAGLMKPSETLTLTCAGYGGYFSTYYWSWMRQTPGKGLECMGEINHSESTNYYPSLMSGVTILLDTSNNQISLKLSSVTDAYTGAYYCATIRLYCYSLTGYYPYGMDDWGKGTMVTVSSGGGGSGGGGSGGGGSSELTQDPAVSVALGQTVRITCQGDSLRSYYTNWFQQKPGQAPVLVVYGKNKRPSGIPDRFSGSSSGNTASLTITGAQAEDEADYYCHYQDSSGNHVLFGGGTKLTVLG

SEQ ID NO: 947 - protein, 250 aa, Homo sapiens
QVQLQQSGAEVKKPGSSVKVSCKTSGGTFNTSAVSWVRQAPGQGLEWMGGIIPIFGTANYAQKFQGRVTITADKSTSTAYMELSSLRSEDTAVYYCATTNYDILTGYYQGVDYWGKGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 948 - protein, 247 aa, Homo sapiens
  Site (227): Xaa equals any of the naturally occurring L-amino acids
QVQLVQSGAEVKKPGASVKVSCKASGYTFTSYGISWVRQAPGQGLEWMGWMNPNSGNTGYAQKFQGRVTMTRNTSTSTAYMELSSLRSEDTAVYYCARGQYYDILTGYNWFDPWGKGTLVTVSSGGGGSGGGGSGGGGSSELTQDPAVSVALGQTVRITCQGDSLRSYYASWYQQKPGQAPVLVIYGKNNRPSGVPDRFSGSSSGNTASLTITGAQAEDEADYYCNXRDSSGNHVVFGGGTKLTVLG

SEQ ID NO: 949 - protein, 251 aa, Homo sapiens
EVQLVESGGGLVKPGGSLRLSCTASGFTFGNAWMTWVRQAPGKGLEWVARIKSKTSDGTTDYAAPVKGRFAISRDDSKNTLYLQMNSLKTEDTAVYYCTTGIYDILTGYHWDDAFDIWGRGTTVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNYRDSSGNHVVFGGGTKLTVLG

SEQ ID NO: 950 - protein, 248 aa, Homo sapiens
QVQLQQSGAEVKKPGASVKVSCKASGYSFTGDYIHWVRQAPGQGLEWMGWINPNSGGTNYSQKFRDRVTMTRDTATSTAYMELSSLGSEDTALYYCARATYDPLTGYSFDGFDIWGQGTMVTVSSGGGGSGGGGSGGGGSSELTQDPAVSVALGQTVRITCQGDSLRSYYTNWFQQKPGQAPLLVVYAKNKRPSGIPDRFSGSSSGNTASLTITGAQAEDEADYYCNSRDSSGNHVVFGGGTKLTVLG

SEQ ID NO: 951 - protein, 251 aa, Homo sapiens
QMQLVQSGGGLVKPGGSLRLSCAASGFTFSDYYMSWIRQAPGKGLEWVSYISSSSSYTNYADSVKGRFTISRDNAKNSLYLQMNSLRAEDTAVYYCARDFYDILTGYPLGGMDVWGKGTLVTVFSGGGGSGGGGSGGGGSQSVLTQPASASGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 952 - protein, 251 aa, Homo sapiens
QVQLVQSGGGVVQPGGSLRLSCAASGFTFSSYGMHWVRQAPGKGLEWVAFIRYDGSNKYYADSVKGRFTISRDNSKNTLYLQMNSLRAEDTAVYYCAKDLPYYDILTGYSLTSGMDVWGRGTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 953 - protein, 248 aa, Homo sapiens
QVQLQQSGAEVKKPGASVKVSCKASGYTFTKYTMHWVRQAPGQGPEWMGWINGGSGDTKYSRKFQGRVTITKDTSVSAAYMELSSLGSEDTALYYCARATYDPLTGYSFDGFDIWGQGTMVTVSSGGGGSGGGGSGGGGSSELTQDPAVSVALGQTVRITCQGDSLRSYYTSWYQQKPGQAPVLVVYGKNNRPSGIPDRFSGSSSGNTASLTITGAQAEDEADYYCNYQDSSGNHVVFGGGTKLTVLG

SEQ ID NO: 954 - protein, 253 aa, Homo sapiens
QVQLQESGAGLLKPSETLSLTCAVYGGSFSGYQWNWIRQPPGKGLEWIGEINHSGSTNYNPSLNSRVTISQDTSNNQFSLKLSSVTAADTAVYYCARGRRYDILTGYYYYHHGMDVWGRGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGDTASLTISGLQAEDEADYYCSSYTTRSTRVFGGGTKLTVLG

SEQ ID NO: 955 - protein, 251 aa, Homo sapiens
EVQLVESGGGVVQPGRSLRLSCAASGFTFSSYGMHWVRQAPGKGLEWVALIWYDGSKKYYADSVKGRFTVSRDNSKNTLYLQMNSLRAEDTAVYYCARSHYDILTGLNYWYFDLWGRGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 956 - protein, 252 aa, Homo sapiens
QVQLVESGGGVVQPGGSLRLSCAASGFTFSSYGMHWVRQAPGKGLEWVAVISYDGSDKYYEDSVKGRFTISRDNSKNTLYLQMNSLRAEDTAVYYCARDSGGDILTGYYMPYFDYWGQGTTVTVSSGGGGSGGGGSGGGGSQSVLTQPASVSGSPGQSITISCTGTSSDVGGYNYVSWYQQHPGKAPKLMIYEGSRRPSGVSNRFSGSKSGNTASLTISGPQAEDEADYYCSSYTTRSTRVFGGGTKLTVLG

SEQ ID NO: 957 - protein, 249 aa, Homo sapiens
QVQLQQWGAGLLKPSETLSLTCAVYGGSFSNYYWSWIRQPPGKGLEWVGEINHSGSTNYNPSLKSRVTISVDTSKNQFSLKLSSVTAADTAVYYCARVGLYYDILTGYYPSGMDVWGKGTLVTVSSGGGGSGGGGSGGGGSSELTQDPAVSVALGQTVRITCQGDSLRSYYTNWFQQKPGQAPLLVVYAKNKRPSGIPDRFSGSSSGNTASLTITGAQAEDEADYYCHSRDSSGNHVLFGGGTKLTVLG

SEQ ID NO: 958 - protein, 257 aa, Homo sapiens
QVQLVQSGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTSQAHYDILTGYYLWSYGMDVWGRGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 959 - protein, 248 aa, Homo sapiens
EVQLVQSGAEVKKPGASVKLSCKASGDTSTYYYMHWVRQAPGQGLEWMGIINPRGGSTSYAQKFQGRVTMTRDTSTSTVYMELSSLTSEDTAVYYCARESYDILTGYRHYGMDLWGRGTTVTVSSGGGGSGGGGSGGGGSSELTQDPAVSVVLGQTVRITCQGDSLRSYYTNWFQQKPGQAPLLVVYAKNKRPSGIPDRFSGSSSGNTASLTITGAQAEDEADYYCHSRDSSGNHVLFGGGTKLTVLG

SEQ ID NO: 960 - protein, 251 aa, Homo sapiens
GVQLVQSGAEVKKPGASVKVSCKASGYTFASFAIHWVRQAPGQRLEWMGWINAGNGNTKYSQKFQGRVTITRDTSASTAYMELSSLRSEDTAVYYCARATYDPLTGYSFDGFDIWGQGAMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 961 - protein, 251 aa, Homo sapiens
EVQLVQSGAEVKKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGKGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 962 - protein, 251 aa, Homo sapiens
EVQLVQSGVEVKKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGKGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 963 - protein, 249 aa, Homo sapiens
EVQLVQSGGGLIQPGGSLRLSCAASGFTFSNYPMTWVRQAPGRGLEWVSTITDSGGNTYYADSVKGRFTISRDNSKDTLFLQMNSLRAEDTAIYYCAKDREYDLLTGYYLHAFDMWGRGTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 964 - protein, 250 aa, Homo sapiens
QVQLQQSRAEVKKPGSSVKVSCKASGGTFSSYAISWVRQAPGQGLEWMGRIIPIVNMANYAQKFQGRVTLTADKSTGTAYMELTSLRSEDTAVYYCARENYDFLTGYYGAFDIWGKGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 965 - protein, 248 aa, Homo sapiens
QVQLQQSGSEVKKTGASVKVSCKASGYTFTKYTMHWVRQAPGQGPEWMGWINGGSGDTKYSRKFQGRITITKDTSASAAYMELSSLGSEDTALYYCARATYDPLTGYSFDGFDIWGRGTMVTVSSGGGGSGGGGSGGGGSSELTQDPAVSVALGQTVRITCQGDSLRSYYTNWFQQKPGQAPLLVVYAKNNRPSGIPDRFSGSSSGNTASLTITGAQAEDEADYYCNSRDSSGNHVVFGGGTKLTVLG

SEQ ID NO: 966 - protein, 253 aa, Homo sapiens
EVQLQQSGGEVKKPGASVRVSCRASGYTFTTYGISWVRQAPGQGLEWMGWISAYYGTTNYAQNLQGRVTMTRDTSTNTVYMELRSLRSEDTAVYYCARDGSYDILTGYYIDNYMDVWGKGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 967 - protein, 248 aa, Homo sapiens
EVQLVQSGAEVKKPGASVRVSCKASGYIFSDYYIHWVRQAPGQGLEWMGRINSKRGVSNYAQNFQGRVTMTRDTSISTAYMELSSLRSDDTAVYYCARDHYDILTGLYYYGMDVWGQGTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 968 - protein, 251 aa, Homo sapiens
GVQLVQSGAEVKKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGQGTLVTVSSGGGGSGGGGSGGGGSQSVLTQPASVSGSPGQSITISCTGTSSDVGGYNYVSWYQQHPGKAPKLMIYEGSRRPSGVSNRFSGSKSGNTASLTISGLQAGDEADYYCSSYTTRSTRVFGGGTKLTVLG

SEQ ID NO: 969 - protein, 247 aa, Homo sapiens
QVQQSGAEVKKPGSSVKVSCKASRGSFSKYGFSWVRQAPGQGLEWMGGIVPIFGATNYAKKFKGRVTITADDDTSTVYMELRSLRSEDTAVYYCARGRRYDILTGYYKGPLDYWGQGTLVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKR

SEQ ID NO: 970 - protein, 248 aa, Homo sapiens
EVQLVQSGAEVKRPGSSVKVSCKASGGTFTNYAISWVRQAPGQGLEWMGRIIPVLGIANYAQKFQGRVTITADKSTTTAYMELSSLRSEDTAVYYCATAYYDNLTGFLPYGMGVWGQGTMVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 971 - protein, 254 aa, Homo sapiens
GVQLVQSGGGVVQPGESLRLSCAASGFTFTTYGMHWVRQAPGKGLEWVSSIGSSSGSTYYADSVKGRFTISRDNSKNTLYLQMNSLRAEDTAVYYCAKEGYDILTGYFLDYYHGMDVWGRGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 972 - protein, 251 aa, Homo sapiens
QVQLVQSGAEVRKPGASVKVSCKTSGYIFSKYTIHWVRQAPGQGPEWMGWINGGSGGTKYPRNFQGRLTISKDTSASVVYMELSSLGSEDTALYYCARATYDPLTGYSFDGFDIWGQGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 973 - protein, 259 aa, Homo sapiens
QMQLVQSGAEVKMPGASVKVSCKASGYTFTSYGISWVRQAPGQGLEWMGWISAYNGNTNYAQKLQGRVTMTTDTSTSTAYMELRSLRSDDTAVYYCARGPRGGPYYDILTGYYLSLSDAFDIWGQGTMVTVSSGGGGSGGGGSGGGGSQSVLTQPPSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLG

SEQ ID NO: 974 - protein, 249 aa, Homo sapiens
EVQLVQSGGGLVQPGGSLRLSCAASGFTFSNYWMTWVRQAPGKGLEWVSSISSSSSYIYYADSVKGRFTISRDNSKNTLYLQMNSLRAEDTAVYYCAREYYDILTGYRDPYGMDVWGQGTMVTVSSGGGGSGGGGSGGGGSSELTQDPAVSVALGQTVRITCQGDSLRSYYTNWFQQKPGQAPLLVVYAKNKRPSGIPDRFSGSSSGNTASLTITGAQAEDEADYYCHSRDSSGNHVLFGGGTKLTVLG

SEQ ID NO: 975 - protein, 251 aa, Homo sapiens
EVQLVQSGAEVKKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGQGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 976 - protein, 251 aa, Homo sapiens
GVQLVQSGAEVKKPGSSVKISCKASGVTFNDYAFSWVRQAPGQGLEWVGGIIPKFGKAKYAQKFQGRLTISGDKSTSTAYMELRSLTSDDTAVYYCARATYDPLTGYSFDGFDIWGQGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 977 - protein, 254 aa, Homo sapiens
GMQLVESGGGVVQPGRSLRLSCAASGFTFSSYAMHWVRQAPGKGLEWVAVISYDGSNKYYADSVKGRFTISRDNSKNTLYLQMNSLRPEDTAVYYCATEVRNYDLLTRSYLAGPLDNWGQGTLVTVSSGGGGSGGGGSGGGGSQSVLTQPASVSGFPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 978 - protein, 251 aa, Homo sapiens
EVQLVQSGAEVKKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGQGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 979 - protein, 251 aa, Homo sapiens
GVQLVQSGAEVKKPGSSVKISCKASGVTFNDYAFSWVRQAPGQGLEWVGGIIPKFGKAKYAQKFQGRLTISGDKSTSTAYMELRSLTSDDTAVYYCARATYDPLTGYSFDGFDIWGQGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNPASLTISGLQAEDEADYYCSSYTTRSTRVFGGGTKLTVLG

SEQ ID NO: 980 - protein, 248 aa, Homo sapiens
HVQLQQSGAEVKKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGRGTMVTVSSGGGGSGGGGSGGGGSSELTQDPAVSVALGQTVRITCQGDSLRSYYTNWFQQKPGQAPVLVIYGKNNRPSGIPDRFSGSSSGNTASLTITGAQAEDEADYYCNSRDSSGNHVVFGGGTKLTVLG

SEQ ID NO: 981 - protein, 254 aa, Homo sapiens
QVQLVQSGGGVVQPGRSLRLSCAASGFTFSSYGMHWVRQAPGKGLEWVAVISYDGSNKYYADSVKGRFTISRDNSKNTLYLQMNSLRAGDTAVYYCARDRGYYDILTGYYRGHGMDVWGRGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 982 - protein, 251 aa, Homo sapiens
QVQLVQSGGGVVQPGGSLRLSCAASGFTFSSYGMHWVRQAPGKGLEWVAFIRYDGSNKYYADSVKGRFTISRDNSKNTLYLQMNSLRAEDTAVYYCAKDLPYYDILTGYSLTSGMDVWGRGTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKPTVLG

SEQ ID NO: 983 - protein, 254 aa, Homo sapiens
QVQLQESGGGVVQPGRSLRLSCAASGFTFSSYAMHWVRQAPGKGLEWVAVISYDGSNKYYADSVKGRFTISRDNSKNTLYLQMNSLRAEDTAVYYCAREEGFYDILTGYYGPGYFDYWGKGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 984 - protein, 248 aa, Homo sapiens
KVQLVQSGAEVKKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGRGTMVTVSSGGGGSGGGGSGGGGSSELTQDPAVSVALGQTVRITCQGDSLRSYYASWYQQKPGQAPVLVIYGKYNRPSGIPDRFSGSSSGNTASLTITGAQAEDEADYYCNSRDSSGNHVVFGGGTKLTVLG

SEQ ID NO: 985 - protein, 247 aa, Homo sapiens
QVQRVVKPSQTLSLTCAISGDSVSSTSAAWNWIRQSPSRGLEWLGRTYYKSGWHYDYAPSVKSRISIKPDTSENHFSLQLNSVIPEDTAVYYCAREGYDILTGYSKFLDYWGQGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 986 - protein, 251 aa, Homo sapiens
QVQLQQSGAEVKKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGQGTMVTVSSGGGGSGGGGSGGGGSQSVLTQPASVSGSPEQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 987 - protein, 248 aa, Homo sapiens
GVQLVQSGAEVKKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGKGTMVTVSSGGGGSGGGGSGGGGSSELTQDPAVSVALGQTVRITCQGDSLRSYYASWYQQKPGQAPVLVIYGKNIRPSGIPDRFSGSSSGNTASLTITGAQAEDEADYYCNSRDSSGNHVVFGGGTKLTVLG

SEQ ID NO: 988 - protein, 252 aa, Homo sapiens
EVQLVESGGGVVQPGRSLRLSCAASGFTFSSYGMHWVRQAPGKGLEWVALIWYDGSKKYYADSVKGRFTVSRDNSKNTLYLQMNSLRAEDTAVYYCARSHYDILTGLNYWYFDLWGRGTLVTVSSGGGGSGGGGSGGGGSQSVLTQPPSVSAAPGQKVTISCSGSTSNIGNNYVSWYQQHPGKAPKLMIYDVSKRPSGVPDRFSGSKSGTSASLAITGVQAEDEADYYCQSYDSSLRGSRVFGTGTKVTVLG

SEQ ID NO: 989 - protein, 253 aa, Homo sapiens
QVQLVESGGGLVQPGGSLRLSCAASGFTFSSYAMSWVRQAPGKGLEWVSAISGSGGSTYYADSVKGRFTISRDNSKNTLYLQMNSLRFEDTAVYYCARERADYDILTGYYFYDMDVWGRGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 990 - protein, 251 aa, Homo sapiens
QVQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARFRYDILTSYYYGMDVWGRGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 991 - protein, 251 aa, Homo sapiens
WVQLVQSGAEVKKPGSSVKISCKASGVTFNDYAFSWVRQAPGQGLEWVGGIIPKFGKAKYAQKFQGRLTISGDKSTSTAYMELTSLTSDDTAVYYCARATYDPLTGYSFDGFDIWGQGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 992 - protein, 251 aa, Homo sapiens
QVQLQQSGAEVKKPGASLKVSCKASGYTFTDYGIHWVRQAPGQGPEWMGWINAGNGYTKYSRKFQGRVTITKDTSASAAYMELSSLGSEDTALYYCARATYDPLTGYSFDGFDIWGRGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 993 - protein, 250 aa, Homo sapiens
QVQLQQWGARVVKPSETLSLTCAVYGGSFSGYQWNWIRQPPGKGLEWIGEINHSGSTNYNPSLNSRVTISQDTSNNQFSLKLSSVTAADTAVYYCARGRRYDILTGYYYYHHGMDVWGKGTLVTVSSGGGGSGGGGSGGGGSSELTQDPAVSVALGQTVRITCQGDSLRSYYTNWFQQKPGQAPLLVVYAKNKRPSGIPDRFSGSSSGNTASLTITGAQAEDEADYYCHSRDSSGNHVLFGGGTKLTVLG

SEQ ID NO: 994 - protein, 253 aa, Homo sapiens
  Site (62): Xaa equals any of the naturally occurring L-amino acids
QVQLVQSGAEVKKPGSSVKVSCKASGGTLSSSTVNWVRQAPGQGLEWMGRIIPMLGIVKYAXKFQGRVMITADKSMTSAYIELSSLRSEDTAVYYCARGHYDILTGYDDYYYGMDVWGRGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 995 - protein, 243 aa, Homo sapiens
QVQLVQSGGGLVQPGGSLRLSCAASGFTVSSNYMSWVRQAPGKGLEWVSVIYSGGNTYYADSVKGRFTISRDNSKNTLYLQMNSLRAEDTAVYYCASHDILTGFDYWGRGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 996 - protein, 247 aa, Homo sapiens
QVTLKESGGGVVQPGRSLRLSCAASGFTFSSYGMHWVRQAPGKGLEWVSAISGSGGSTYYADSVKGRFTISRDNSKNTLYLQMNSLRAEDTAVYYCARSGYDILTGYLYGMDVWGQGTMVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 997 - protein, 251 aa, Homo sapiens
EVQLVQSGGGLVQPGGSLRLSCAASGFTFSDHYMDWVRQAPGKGLEWVGRARNKANSYTIEYAASVKGRFTISRDDSKNSLFLQMNSLKTEDTAVYYCARAPYDILTGYSDYYGMDVWGRGTLVTVSSGGGGSGGGGSGGGGSSELTQDPAVSVASGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 998 - protein, 251 aa, Homo sapiens
EVQLVQSGAEVRKPGASVRVSCKASGYTFSRYPIHWVRQAPGQRLEWMGWIDSAKGHIKYSQKFQGRLTLTRDTSANTAYMELTSLTSEDTALYYCARATYDPLTGYSFDGFDIWGRGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 999 - protein, 247 aa, Homo sapiens
EVQLVQSGAEVKKPGASVKVSCRASGYTFTRYSTHWVRQAPGQRFEWMGWINGGNGNTKYSQTFQGRITITRDTPASTVYMELSSLRSEDTAMYYCARGDYDPLTGYSFGVDVWGQGTMVTVSSGGGGSGGGGSGGGGSSELTQDPAVSVALGQTVRITCQGDSLKSYYTNWFQQKPGQAPLLVVYAKNKRPSGIPDRFSGSSSGNTASLTITGAQAEDEADYYCHSRDSSGNHVLFGGGTKLTVLG

SEQ ID NO: 1000 - protein, 253 aa, Homo sapiens
QVQLVQSGGGEVQPGRSLRLSCAASGFTFSSYGMHWVRQAPGKGLEWVSVTYSGGNTNYADSVRGRFTISRDNPKNTLYLQMNSLRAEDTAVYYCAREGSYDILTGYYVGVGRMDVWGRGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLD

SEQ ID NO: 1001 - protein, 254 aa, Homo sapiens
EVQLVQSGAEVKKPGSSVKVSCKASGGTLSNFAISWVRQAPGQGLEWMGIINPSGGNTVYAQKFQGRVSMTRETSTSTVYMEMRSLRSEDTAVYYCARDGYYDILTGGFYYYYGMDVWGQGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLR

SEQ ID NO: 1002 - protein, 246 aa, Homo sapiens
EVQLVQSGGGLVKPGGSLTLSCAASGFTVSSNYMSWIRQAPGKGLEWVSSIRGSGSAVYYADSVKGRFTISRDNSKNTLYLQMNSLRAEDTAVYYCAPAYYDILTGLDYWGRGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1003 - protein, 253 aa, Homo sapiens
QVQLQESGGGLVQPGGSLRLSCAASGFTFSSYWMGWVRQAPGKGLEWVANIKQDGSEKYYVDSVKGRFTISRDNAKNSLYLQMNSLRAEDTAVYYCARDQQYDILTGYYIHYGMDVWGRGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1004 - protein, 248 aa, Homo sapiens
EVQLVESGGGVVQPGRSRRLSCAASGFTFSYHSMHWVRQAPGKGLEWVAAISFDGSEKYYADSVQGRFTVSRDNSKNTLYLQMNSLRAEDTAVYYCARDQVDLLLMDHNYYMDVWGQGTLVTVSSGGGGSGGGGSGGGGSDIVMTQSPSTLSASVGDRVTITCRASQGISSWLAWYQQKPGRAPKVLIYKASTLESGVPSRFSGSGSGTDFTLTISSLQPEDFATYYCQQSYSTPWTFGQGTKLEIKR

SEQ ID NO: 1005 - protein, 251 aa, Homo sapiens
QVQLQQSGAEVKKPGASVKISCKASGYTFVNYGVHWVRQAPGQRLEWMGWINAGNGNTKYSQKFQGRVTITRDTSASTAYMELSRLTSEDTALYYCARATYDPLTGYSFDGFDIWGRGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1006 - protein, 253 aa, Homo sapiens
GVQLVESGGGLVQPGGSLRLSCAASGFSVSSNHMNWVRQAPGKGLEWVSVTYSGGNTNYADSVRGRFTISRDNSKNTLYLQMNGLRAEDTAVYYCAREGSYDILTGYYVGVGRMDVWGRGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1007 - protein, 253 aa, Homo sapiens
  Site (175): Xaa equals any of the naturally occurring L-amino acids
  Site (209): Xaa equals any of the naturally occurring L-amino acids
QVQLQESGGGLVQPGGSLRLSCAASGFTFSSYWMGWVRQAPGKGLEWVANIKQDGSEKYYVDSVKGRFTISRDNAKNSLYLQMNSLRAEDTAVYYCARDQQYDILTGYYIHYGMDVWGRGTLVTVSSGGGGSGGGGSGGGGSQSVLTQPASVSGSPGQSITISCTGTSSDVGGYXYVSWYQQHPGKAPKLMIYEGSKRPSGVSNRFSGXKSGNTASLTISGLQAEDEADYYCSSYTTRSTRVFGGGTKLTVLG

SEQ ID NO: 1008 - protein, 248 aa, Homo sapiens
QVQLVQSGAEVKKPGSSVKVSCKASGYTFTSYGINWVRQAPGQGLEWMGSIIPSFATANYAQKFRGRLTITADESTTTAYMELSSLGSEDTAVYYCARTKYDILTGYYYYYMDVWGQGTTVTVSSGGGGSGGGGSGGGGSDIQMTQSPSTLSASIGDKVTITCRASEGIYHWLAWYQQKPGKAPKLLIYKASSLASGAPSRFSGSGSGTDFTLTISSLQPDDFATYYCQQYSNYPLTFGGGTKLEIKR

SEQ ID NO: 1009 - protein, 249 aa, Homo sapiens
QVQLVQSGAEVKKPGSSVKVSCRASVGSFNHAISWVRQAPGRGLEWMGGILPMYGTANYAQKFQGRVTITADKLTNTVYMDLSRLRYEDTAVYYCARELGLSIVGATTGALDMWGRGTLVTVSSGGGGSGGGGSGGGGSAQSVLTQPPSASGTPGQRVTISCSGSYSNIGTNDVFWYQQLPGTAPQLLIYRNNQRPSGVPDRFSGSKSGTSASLAISGLRSEDEADYYCAAWNDRQIVFGGGTKLTVIG

SEQ ID NO: 1010 - protein, 251 aa, Homo sapiens
QVQLVQSGAEVKKPGSSVKVSCRASLGSFNHAISWVRQAPGRGLEWMGGILPMYGTANYAQKFQGRVTITADKLTNTVYMDLSRLRYEDTAVYYCARELGLSIVGATTGALDMWGRGTLVTVSSGGGGSGGGGSGGGGSAQSALTQPASVSGSPGQSITISCTGTSSDVGAYDYVSWYQHHPGKAPKLMIYDVSNRPSGVSNRFSGSKSGNTASLTISGLQAEDEADYYCNSYTNSPTYVFGTGTKLTVLG

SEQ ID NO: 1011 - protein, 251 aa, Homo sapiens
QVQLVQSGAEVKKPGSSVKVSCRASGGSFNHAISWVRQAPGRGLEWMGGILPMYGTANYAQKFQGRVTITADKLTNTVYMDLSRLRYEDTAVYYCARELGLSIVGATTGALDMWGRGTLVTVSSGGGGSGGGGSGGGGSAQAVLTQPSSASGTPGQRVTISCSGSSSNIGSNTVNWYQQLPGTAPKLLIYSNNERPSGVPDRFSGSKSGTSASLAISGLQSEDEADYYCVAWDDSLNGWVFGGGTKVTVLG

SEQ ID NO: 1012 - protein, 255 aa, Homo sapiens
QVQLVQSGAEVKKPGSSVKVSCKASGGRFSRYATTWVRQAPGQGLEWMGGIIPLFGTTKYAQRLQGRVTITADELTNTAFMELRSLRSEDTALYYCATTDRFGAKDVTSRWGMDVWGQGTLVTVSSGGGGSGGGGSGGGGSAQSVLTQPPSVSGAPGQRVTVSCTGSSSNIGAGYGVHWYQQLPGTAPKLLIYGNTNRLSGVPDRFSGSQSGSSASLAITGLQADDEADYYCQSYDSSLSGSFVFGTGTKVTVLG

SEQ ID NO: 1013 - protein, 251 aa, Homo sapiens
QVQLVQSGAEVKKPGSSVKVSCRASGGSFNHAISWVRQAPGRGLEWMGGILPMYGTANYAQKFQGRVTITADKLTNTVYMDLSRLRYEDTAVYYCARELGLSIVGATTGALDMWGRGTLVTVSSGGGGSGGGGSGGGGSAQSALTQPASVSGSPGQSITISCTGTSSDVGAYDYVSWYQHHPGKAPKLMIYDVSNRPSGVSNRFSGSKSGNTASLTISGLQAEDEADYYCNSYTNSPTYVFGTGTKLTVLG

SEQ ID NO: 1014 - protein, 250 aa, Homo sapiens
QVQLVQSGAEVKKPGSSVKVSCRASGGSFNHAISWVRQAPGRGLEWMGGILPMYGTANYAQKFQGRVTITADKLTNTVYMDLSRLRYEDTAVYYCARELGLSIVGATTGALDMWGRGTMVTVSSGGGGSGGGGSGGGGSALSSELTQDPAVSVALGQTVRITCQGDMFRNYYATWYQQRPGQAPVPVLYGQNNRPSGIPERFSGSRSGKTASLTITGAQAEDEADYYCGSRDSSGSHLLFGGGTKLTVLG

SEQ ID NO: 1015 - protein, 256 aa, Homo sapiens
EVQLVETGGGVVQPGGSLRLSCVGSGFTFSSYGMHWVRQAPGKGLEWMAVISSDGTKRYYADSVQGRLTISRDNFVKTLSLEMHSLRAEDTAVYYCAKDRGGNYDILTGYYFHHGVDVWGRGTMVTVSSGGGGSGGGGSGGGGSAQSVVTQPPSVSAAPGQKVTISCSGSSSNIGSNYVSWYQQLPGTAPKLLIYDNNKRPSGIPDRFSGSKSGTSATLGIAGLQTGDEADYYCGTWDGSLSGGVFGGGTKLTVLG

SEQ ID NO: 1016 - protein, 252 aa, Homo sapiens
QVQLVQSGAEVKKPGSSVKVSCRASGGSFNHAISWVRQAPGRGLEWMGGILPMYGTANYAQKFQGRVTITADKLTNTVYMDLSRLRYEDTAVYYCARELGLSIVGATTGALDMWGRGTLVTVSSGGGGSGGGGSGGGGSALSYVLTQPPSASGTPGQRVTISCSGSSSNIGNNYVFWYQQLPGAAPKLLIYRNSQRPSGVPDRFSGSTSGTSASLAISGLRSEDEADYYCAARDDSLRGPVFGGGTKLTVLG

SEQ ID NO: 1017 - protein, 250 aa, Homo sapiens
QVQLVQSGAEVKKPGSSVKVSCKASGGTFTSYAFNWVRRAPGQGLEWLGSIVPVFNTKTFARKFQGRVTLTADELTRTAYLELSNLRSDDTAVYYCASRYGDPFYYYYYMNVWGKGTLVTVSSGGGGSGGGGSGGGGSAQSVLTQPPSASGTPGQRVIISCSGSASNIAANPVNWYQQFPGTAPKLLIYSNNERPSGVPDRFSGSKSGTSASLAISGLQSEDEADYYCAAWDDSLNAVVFGGGTKLTVLG

SEQ ID NO: 1018 - protein, 247 aa, Homo sapiens
QVQLVQSGAEVKKPGSSVKVSCRASGGSFNHAISWVRQAPGRGLEWMGGILPMYGTANYAQKFQGRVTITADKLTNTVYMDLSRLRYEDTAVYYCARELGLSIVGATTGALDMWGKGTLVTVSSGGGGSGGGGSGGGGSAQSVLTQPPSVSVSPGQTASITCSGDNLGNKYVYWYQQKAGQSPVLVIYQDTKRPSGIPERFSGSNSGNTATLTISGTQTMDEADYYCQAWDNNIVVFGGGTKLTVLG

SEQ ID NO: 1019 - protein, 249 aa, Homo sapiens
QVQLVQSGAEVKKPGSSVKVSCRASGGSFNHAISWVRQAPGRGLEWMGGILPMYGTANYAQKFQGRVTITADKLTNTVYMDLSRLRYEDTAVYYCARELGLSIVGATTGALDMWGRGTLVTVSSGGGGSGGGGSGGGGSAQPVLTQPPSVSVAPGKTARMTCGGDNIGNKGVHWYQQKPGQAPVVVFYYGRDRPSGIPERFSGSSSGNTATLTISRVEAGDEADYFCQVWDSSSDHAVFGGGTQLTVLS

SEQ ID NO: 1020 - protein, 251 aa, Homo sapiens
EVQLVQSGAEVKKPGSSVKVSCRASGGSFNHAISWVRQAPGRGLEWMGGILPMYGTANYAQKFQGRVTITADKLTNTVYMDLSRLRYEDTAVYYCARELGLSIVGATTGALDMWGRGTMVTVSSGGGGSGGGGSGGGGSALSYVLTQPPSASGTPGQRVTISCSGSRSDIGNNDVNWYQQLPGTAPKLLIYSSNQRPSGVPDRFSGSKSGTSASLAISGLQSEDEADYYCATWDDSLKGVFGGGTKLTVLG

SEQ ID NO: 1021 - protein, 252 aa, Homo sapiens
QVQLVQSGAEVKKPGSSVKVSCRASGGSFNHAISWVRQAPGRGLEWMGGILPMYGTANYAQKFQGRVTITADKLTNTVYMDLSRLRYEDTAVYYCARELGLSIVGATTGALDMWGKGTLVTVSSGGGGSGGGGSGGGGSALSYELTQPPSASGTPGQRVTISCSGSSSNIGNNYIYWYQQLPGTAPKLLIGRYDQRPSGVPDRFSGSKSGTSASLAISGLRSEDEADYYCATWDDSLSGWVFGGGTQLTVLS

SEQ ID NO: 1022 - protein, 250 aa, Homo sapiens
QVQLVQSGAEVKKPGSSVKVSCKASGGTFSSYAFNWVRRAPGQGLEWLGSIVPVFNTKTFARKFQGRVTLTADELTRTAYLELSNLRSDDTAVYYCASRYGDPFYYYYYMNVWGQGTLVTVSSGGGGSGGGGSGGGGSALSSELTQDPAVSVALGQTVRITCQGDSLRKYYASWYHQKPGQAPVLVMYGENNRPSGIPDRFSGSRSGNTASLTITGAQAEDEADYYCYSRDSISDHLEVFGGGTKLTVLG

SEQ ID NO: 1023 - protein, 251 aa, Homo sapiens
QVQLVQSGAEVKKPGSSVKVSCKASGGTFSSYAFNWVRRAPGQGLEWLGSIVPVFNTKTFARKFQGRVTLTADELTRTAYLELSNLRSDDTAVYYCASRYGDPFYYYYYMNVWGKGTLVTVSSGGGGSGGGGSGGGGSAQAVLTQPSSVSGAPGQRVTLSCTGSRSNLGAGYDVNWYQQLPGTAPKLLIYGNTNRPSGVGERFSGSKSGTSASLVITGLQAGDEADYYCQSYDSSHSARVFGGGTKLTVLG

SEQ ID NO: 1024 - protein, 249 aa, Homo sapiens
QVQLVQSGAEVKKPGSSVKVSCRASGGSFNHAISWVRQAPGRGLEWMGGILPMYGTANYAQKFQGRVTITADKLTNTVYMDLSRLRYEDTAVYYCARELGLSIVGATTGALDMWGRGTLVTVSSGGGGSGGGGSGGGGSAQSVLTQPPSVSVAPGQTARITCGGNNIESKSVHWYQQKPGQAPVLVVYDDTDRPSGIPERFSGSNSGSSATLSISRVEVGDEADYYCLVWETTNHHYVFGTGTKVTVLG

SEQ ID NO: 1025 - protein, 259 aa, Homo sapiens
QVQLVQSGAEVKKPGSSVKVSCRASGGSFIDDSINWLRQAPGQGLEWVGGTIPLANRANYAQKFRDRATITADELTATVFLELTSLRSDDTALYYCARSSPPKWYDALTGHSSYHSAMDVWGRGTLVTVSSGGGGSGGGGSGGGGSAQSVLTQPPSASGTPGQRVTISCSGTNSNIGGNTVNWYQQLPGTAPRLLIYSNNQRPSGVPDRFSGSKSGTSASLAISGLQSEDEADYYCATRDDRLNAHVVFGGGTKVTVLG

SEQ ID NO: 1026 - protein, 256 aa, Homo sapiens
QVQLVQSGAEVKKPGSSVKVSCRASGGSFIDDSINWLRQAPGQGLEWVGGTIPLANRANYAQKFRDRVTITADELTATVFLELTSLRSDDTALYYCARSSPPKWYDALTGHSSYHSAMDVWGKGTLVTVSSGGGGSGGGGSGGGGSALSSELTQDPAVSVALGQTVRITCQGDSLRKYSVSWYQQKPGQAPVFVMYAKNNRPSGIPDRFSGSSSGNTASLTITGSQAEDEADYYCSSRNVSGKRVFGGGTKVTVLG

SEQ ID NO: 1027 - protein, 256 aa, Homo sapiens
QVQLVQSGAEVKKPGSSVKVSCRVSGGSFTDDSINWLRQAPGQGLEWVGGTIPLANRANYAQKFRDRVTITADELTATVFLELTSLRSDDTALYYCARSSPPKWYDALTGDSSYHSAMDVWGRGTLVTVSSGGGGSGGGGSGGGGSALDIQMTQSPSSLSASVGDRVRMTCRTSQTINKYLNWYQQKPGQAPKLLIFAASSLYSGVPSRFSGSGSGTDFTLTISSLQPEDFATYYCQQTYKTPRTFGQGTKVEIKR

SEQ ID NO: 1028 - protein, 257 aa, Homo sapiens
QVQLVQSGAEVKKPGSSVKVSCRASGGSFIDDSINWLRQAPGQGLEWVGGTIPLANRANYAQKFRDRVTITADELTATVFLELTSLRSDDTALYYCARSSPPKWYDALTGHSSYHSAMDVWGRGTLVTVSSGGGGSGGGGSGGGGSALSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1029 - protein, 258 aa, Homo sapiens
QVQLVQSGAEVKKPGSSVKVSCRVSGGSFTDDSINWLRQAPGQGLEWVGGTIPLANRANYAQKFRDRVTITADELTATVFLELTSLRSDDTALYYCARSSPPKWYDALTGDSSYRSAMDVWGRGTLVTVSSGGGGSGGGGSGGGGSAQAVLTQPSSVSAAPGQKVTISCSGSSSNIGKSYVSWYQQFPGTAPKLLMYENSERPSGIPDRFSGSKSGTSATLGITGVQTGDEADYYCATWDSSLRAGVFGGGTKVTVLG

SEQ ID NO: 1030 - protein, 249 aa, Homo sapiens
QVQLVQSGAEVRKPGSSVKVSCKASGGSFSSHVFSWVRQAPGQGLEWVGGITPKFATPNYAQKFQHRVTITADELTRTVFMDLSGLRSEDTAVYYCARGYDSSAFRAFDIWGRGTLVTVSSGGGGSGGGGSGGGGSALSYELTQPPSASGTPGQAVAVSCSGTSSNTGKYGVKWYQQLPGMAPKLLIYSNSQRPLGVPDRFSGSKSGTSASLAISDLRSEDEADYYCQTWDDTLKSNIFGGGTKLTVLG

SEQ ID NO: 1031 - protein, 248 aa, Homo sapiens
QVQLVQSGAEVRKPGSSVKVSCKASGGSFSSHVFSWVRQAPGQGLEWVGGITPKFATPNYAQKFQHRVTITADELTRTVFMDLSGLRSEDTAVYYCARGYDSSAFRAFDIWGRGTLVTVSSGGGGSGGGGSGGGGSAQAVLTQPSSVSGAPGQRVTISCTGSSSNIGANYDVQWYQQLPGTAPKLLIYGNNNRPSGVPSRFSGSKSGTSASLVITGLQSEDEADYNCQSYDTGLGEVFGGGTKVTVLG

SEQ ID NO: 1032 - protein, 259 aa, Homo sapiens
QMQLVQSGAEVKKPGSSVKVSCRVSGGSFIDDSINWLRQAPGQGLEWVGGTIPLANRANYAQKFRDRVTITADELTATVFLELTSLRSDDTALYYCARSSPPKWYDALTGDSSYHSAMDVWGRGTLVTVSSGGGGSGGGGSGGGGSAQSVLTQPPSVSGAPGQRVTISCTGSSSNIGGGFDAHWYRQVPGRAPKLLIFGNTDRPSGVPDRFSGSKSGTSASLVITGLQAEDEANYYCQAYDSRLSGYVFGTGTKVTVLG

SEQ ID NO: 1033 - protein, 257 aa, Homo sapiens
QVQLQQSGAEVRKSGSSVKVSCRTSGGAFSNYAISWVRQAPGQGLQWMGGIIPVFSTADYEEKFEGRLKITADRLTSTVFMELSSLTSEDTAVYYCAGGLRHVTLFGTGTRGHFYMDVWGQGTTVTVSSGGGGSGGGGSGGGGSAQAVLTQPSSVSGAPGQSVTISCTGSSSNIGAGYDVHWYRQLPRTAPKLLIPGNNNGPSGVSDRFSGSKSGTSASLAITGLRAEDEADYYCQSYDRSLKSYVFGSGTKVTVLG

SEQ ID NO: 1034 - protein, 259 aa, Homo sapiens
EVQLVESGAEVKKPGSSVKVSCKASGGALSSDAISWVRQAPGQGLEWMGGIIPTFRKTKYAQKFQGRVTITADELTRTVFMELSSLKSEDTAVYYCARGREDTDKVKPWDRYYHYYYMDVWGRGTLVTVSSGGGGSGGGGSGGGGSAQSVLTQPPSVSGAPGQRVTISCTGGSSNIGAGHAVHWYQKLPGTAPKVLIYGNSNRPSGVPDRFSGSKSGTSASLAITGLQAEDEADYYCQSYDNSVGGFVFGTGTKLTVLG

SEQ ID NO: 1035 - protein, 249 aa, Homo sapiens
QVQLVQSGAEVRKPGSSVKVSCKASGGSFSSHVFSWVRQAPGQGLEWVGGITPKFATPNYAQKFQHRVTITADELTRTVFMDLSGLRSEDTAVYYCARGYDSSAFRAFDIWGQGTLVTVSSGGGGSGGGGSGGGGSALETTLTQSPGSLSLSPGERATLSCKASQSVSSNFLAWYQQKPGQAPRLLIYGASSRATGIPDRFSGSGSGTDFTLTISSLEPEDFAVYYCQQYGTSPVWVTFGQGTRLEIKR

SEQ ID NO: 1036 - protein, 260 aa, Homo sapiens
QMQLVQSGAEVKRPGSSVKVSCRVSGGSFTDDSINWLRQAPGQGLEWVGGTIPLANRANYAQKFRDRVTITADELTATVFLELTSLRSDDTALYYCARSSPPKWYDALTGDSSYHSAMDVWGRGTMVTVSSGGGGSGGGGSGGGGSAQAVLTQPSSVSGAPGQRVTISCTGSSSNIWAGYDVHWYQQLPGAAPKLLIRGNGNRPSGVPDRFSVSKSGYSASLAITGLQPADEGVYYCQSYDSSLSGSKVFGQGTKVTVLG

SEQ ID NO: 1037 - protein, 248 aa, Homo sapiens
QVQLVQSGAEVRKPGSSVKVSCKASGGSFSSHVFSWVRQAPGQGLEWVGGITPKFATPNYAQKFQHRVTITADELTRTVFMDLSGLRSEDTAVYYCARGYDSSAFRAFDIWGRGTTVTVSSGGGGSGGGGSGGGGSAQSVLTQPPSASGTPGQRVTISCSGSRSNIGENYVYWYQQLPGTAPKLLIYKNNQRPSGVPDRFSGSRSGTSASLAISGLRSEDEAVYYCASWDDSLSGPVFGRGTKVTVLG

SEQ ID NO: 1038 - protein, 258 aa, Homo sapiens
QVQLVQSGAEVKKPGSSVKVSCRASGGSFIDDSINWLRQAPGQGLEWVGGTIPLANRANYAQKFRGRVTITADELTATVFLELTSLRSDDTALYYCARSSPPKWYDALTGHSSYHSAMDVWGRGTLVTVSSGGGGSGGGGSGGGGSAQSVLTQPPSASGTPGQRVTISCSGSTSNIGSNTITWYQQLPGAAPKLLIYSTNQRPAGVPDRFSGSKSGTSASLAISGLQSEDEADYFCATWDDSLSGPVFGGGTKVTVLG

SEQ ID NO: 1039 - protein, 260 aa, Homo sapiens
EVQLVQSGPEVKKPGSSVKVSCRTSGGTFRNYGLSWVRQAPGQGLEWMGGVIPISSTIKYGQKFQDRLTIVADDLTNTTYMELSSLRPEDTAVYYCARAATTSQKHNKYAYYFYGMDVWGRGTTVTVSSGGGGSGGGGSGGGGSALDVVMTQSPLSLPVTPGEPASISCRSSQSLLHSNGNIYLDWYLQKPGQPPQLLIYMGSNRASGVPDRFSGSGSGTDFTLRISRVEAEDVGVSYCMEALHTPAITFGQGTRLEIKR

SEQ ID NO: 1040 - protein, 248 aa, Homo sapiens
QVQLVQSGAEVRKPGSSVKVSCKASGGSFSSHVFSWVRQAPGQGLEWVGGITPKFATPNYAQKFQHRVTITADELTRTVFMDLSGLRSEDTAVYYCARGYDSSAFRAFDIWGRGTLVTVSSGGGGSGGGGSGGGGSALPVLTQPPSASGTPGQRVSISCSGSGSNIGSKPVNWYQQLPGTVPKLIIYSSNKRPSEVADRFSGSKSGTSASLAISGLQSEDEAEYYCASWDDRLNGWMFGGGTKVTVLG

SEQ ID NO: 1041 - protein, 259 aa, Homo sapiens
QVQLVQSGAEVKKPGSSVKVSCRASGGSFIDDSINWLRQAPGQGLEWVGGTIPLANRANYAQKFRDRVTITADELTATVFLELTSLRSDDTALYYCARSSPPKWYDALTGHSSYHSAMDVWGQGTLVTVSSGGGGSGGGGSGGGGSAQAVLTQPSSVSGAPGQRVTISCTGSESNIGAGYDVHWYLQLPGAAPKLLIYGNKYRSSGVPDRFSGSKSGTSASLAITGLRVEDEAEYVCQSYDKSLSGYVFGPGTKVTVLG

SEQ ID NO: 1042 - protein, 258 aa, Homo sapiens
QVQLVQSGAEVSKPGSSVKVSCRASGGSLIDYSINWVRQAPGQGLEWVGGTVPLANTANYAQKFRGRVTITADELTATVFLELTSLRSDDTALYYCAKSSPPKWYDALTGHSSYHSAMDVWGKGTLVTVSSGGGGSGGGGSGGGGSAQSVLTQPPSASGTPGQRVTIRCSGSSSNIGSNFVFWYQQLPGTAPKVLITRNNKRPSGVPDRFSGSKSGTSASLAISGLRSEDEADYHCVAWDDRLRGWVFGGGTKVTVLG

SEQ ID NO: 1043 - protein, 259 aa, Homo sapiens
EVQLVQSGAEVKKPGSSVKVSCKASGGALSSDAISWVRQAPGQGLEWMGGIIPTFRKTKYAQKFQGRVTITADELTRTVFMELSSLKSEDTAVYYCARGREDTDKVKPWDRYYHYYYMDVWGRGTTVTVSSGGGGSGGGGSGGGGSAQAVLTQPSSVSEAPGQRVTISCTGSSSNIGAGYDVHWYKQLPGTAPKLLIFDTNNRPSGVPARFSGSKSGTSAALAITGLQAGDEAYYYCQSYDLTFSGSVFGTGTKVTVLG

SEQ ID NO: 1044 - protein, 253 aa, Homo sapiens
QVQQSGAEVKKPGGTLRLSCAASGFTFSSYSMNWVRQAPGKGLEWVSSISSSSSYIYYADSVKGRFTISRDNAKNSLYLQMNSLRAEDTAVYYCAREGGNYDILTGYYIGNGAFDIWGRGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYYSSYTNRSTRVFGGGTKLTVLG

SEQ ID NO: 1045 - protein, 254 aa, Homo sapiens
QVQLVQSGAEVKKPGSSVKVSCQASGGNFNSYGVSWVRQAPGQGLEWMGRIIPNVGTANYAQKFQGRVTITADKLTSTVYLEVRSLRSEDTAVYYCARGDYDILTGYPAECFQIWGKGTLVTVSSGGGGSGGGGSGGGGSAQSVLTQPPSVSGAPGQRVTISCTGSSSNIGAGYDVHWYRHIPGTAPKLLIYGNSHNRPSGVPDRFSGSKSGTSASLAITGLQAEDEADYFCQSYDSSLSAVVFGGGTKVTVLG

SEQ ID NO: 1046 - protein, 251 aa, Homo sapiens
QVQLQQSGAEVKKPGASVKVSCKASKYTFANHYIHWVRQAPGEGLEWMGNINPSGSSTRYAQRFQGRVTMTRDTSTSTVYMELSNLRSDDTAVYYCARATYDPLTGYSFDGFDIWGKGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTKRSTRVFGGGTKLTVLG

SEQ ID NO: 1047 - protein, 251 aa, Homo sapiens
QVQLQQSGAEVKKPGASVKVSCKASKYTFANHYIHWVRQAPGEGLEWMGNINPSGSSTRYAQRFQGRVTMTRDTSTSTVYMELSNLRSDDTAVYYCARATYDPLTGYSFDGFDIWGKGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTNRSTRVFGGGTKLTVLG

SEQ ID NO: 1048 - protein, 252 aa, Homo sapiens
QVQLVQSGAEVKKPGSSVKVSCRASGGSFNHAISWVRQAPGRGLEWMGGILPMYGTANYAQKFQGRVTITADKLTNTVYMDLSRLRYEDTAVYYCARELGLSIVGATTGALDMWGRGTLVTVSSGGGGSGGGGSGGGGSALSYELTQPPSASGTPGQRVTISCSGSSSNIGSNTVNWYQQLPGTAPKLLIYNNDQRPSGVPARFSGSKSGTSASLAISGLQSEDEAVYYCASWDDSLNGPVFGGGTKLTVLG

SEQ ID NO: 1049 - protein, 251 aa, Homo sapiens
QLQLQESGPGLVKPSETLSLTCTVSGGFISSRTSYWGWIRQPPGKGPEWIGNIYYTGKTYYSPSLKSRVTISVDTSKNQLSLKLNSVTAADTAVYYCARAGYDLLTGYPFYFDSWGKGTLVTVSSGGGGSGGGGSGGGGSALEIVLTQSPATLSLSPGERATLSCRASQSVSSYLAWYQQKPGQAPRLLIYDASNRATGIPARFSGSGSGTDFTLTISSLEPEDFAVYYCQQRSNWPFLTFGGGTKVEIKR

SEQ ID NO: 1050 - protein, 251 aa, Homo sapiens
GVQLQQWGGGVVQPGRSLRLSCAASEFTFSSYAMHWVRQAPGKGLEWVAVVSDDGRNKYYAESVKGRFTISRDNSKSTLYLQMNSLRAEDTAVYYCATEVRNYDLLTRSYLAGPLDNWGKGTMVTVSSGGGGSGGGGSGGGGSSELTQDHAVSVALGQTVRITCQGDSLRSYYASWYQQKPGQAPVLVVYAKNKRPSGIPDRFSGSSSGNTASLTITGAQAEDEADYYCHSRDSSGNHVLFGGGTKLTVLG

SEQ ID NO: 1051 - protein, 251 aa, Homo sapiens
EVQLVQSGAEVKKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGKGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDENDYNCSSYTTRSTRVFGGGTKLTVLG

SEQ ID NO: 1052 - protein, 251 aa, Homo sapiens
QVQLQQSGAEVKKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGRGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRDFGGGTKLTVLG

SEQ ID NO: 1053 - protein, 251 aa, Homo sapiens
QVQLQQSGAEVKKPGASVKVSCKASKYTFANHYIHWVRQAPGEGLEWMGNINPSGSSTRYAQRFQGRVTMTRDTSTSTVYMELSNLRSDDTAVYYCARATYDPLTGYSFDGFDIWGKGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRDFGGGTKLTVLG

SEQ ID NO: 1054 - protein, 255 aa, Homo sapiens
GVQLVQSGAEVKKPGASVKVSCKASGHTFTSDHISWVRQAPGQGLEWMGWISPHHGKTNYAQKLQGRVTMTTDTSTSTAYMELRSLRSDDTAVYYCARVQMDSEYYDLLTGINVGPYYFDYWGKGTPVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1055 - protein, 251 aa, Homo sapiens
HVQLQQSGAEVKKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGQGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1056 - protein, 255 aa, Homo sapiens
QMQLVQSGAEVKKPGASVKVSCKASGYTFTSDHISWVRQAPGQGLEWMGWISPHHGKTNYAQKLQGRVTMTTDTSTSTAYMELRSLRSDDTAVYYCARVQMDSEYYDLLTGINVGPYYFDYWGQGTLVTVSSGGGGSGGGGSGGGGSSELTQDPAVSVALGQTVRITCQGDSLRSYYASWYQQKPGQAPVLVIYGETNRPSGIPDRFSGSSSGNTASLTITGAQAEDEADYYCNSRDSSGNHVVFGGGTKLTVLG

SEQ ID NO: 1057 - protein, 251 aa, Homo sapiens
QVQLVQSGAEVKKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGQGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1058 - protein, 251 aa, Homo sapiens
QVQLQQSGAEVKKPGASVKVSCKASKYTFANHYIHWVRQAPGEGLEWMGNINPSGSSTRYAQRFQGRVTMTRDTSTSTVYMELSNLRSDDTAVYYCARATYDPLTGYSFDGFDIWGKGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEDDYYCSSYTTRSTRVFGGGTKLTVLG

SEQ ID NO: 1059 - protein, 251 aa, Homo sapiens
EVQLVQSGAEVKKPGASVKVSCKASGYSFTKYTMHWVRQAPGQGPEWMGWINGGSGDTRYSRKFQGRVTITKDTSASAAYMELSSLGSEDTALYYCARATYDPLTGYSFDGFDIWGQGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1060 - protein, 251 aa, Homo sapiens
QVQLQQSGAEVKKPGASVKVSCKASKYTFANHYIHWVRQAPGEGLEWMGNINPSGSSTRYAQRFQGRVTMTRDTSTSTVYMELSNLRSEDTAVYYCARATYDPLTGYSFDGFDIWGKGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1061 - protein, 251 aa, Homo sapiens
KVQLQQSGAEVKKPGASVKVSCKASKYTFANHYIHWVRQAPGEGLEWMGNINPSGSSTRYAQRFQGRVTMTRDTSTSTVYMELSNLRSDDTAVYYCARATYDPLTGYSFDGFDIWGKGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1062 - protein, 251 aa, Homo sapiens
EVQLVQSGAEVKKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGQGTLVTVSSGGGGSGGGGSGGGGSQPVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1063 - protein, 251 aa, Homo sapiens
QVQLQQSGAEVKKPGASVKVSCKASKYTFANHYIHWVRQAPGEGLEWMGNINPSGSSTRYAQRFQGRVTMTRDTSTSTVYMELSNLRSDDTAVYYCARATYDPLTGYSFDGFDIWGKGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEEEADYYCSSYTTRSTRVFGGGTKLTVLG

SEQ ID NO: 1064 - protein, 251 aa, Homo sapiens
QVQLQQSGAEVKKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGRGTMVTVSSGGGGSGGGGSGGGGSQSVLTQPASVSGSPGQSITIYCTGTSSDVGGYNYVSWYQQHPGKAPKLMIYEGSKRPSGVSNRFSGSKSGNTASLTISGLQAEDEADYYCSSYTTRSTRDFGGGTKLTVLG

SEQ ID NO: 1065 - protein, 255 aa, Homo sapiens
RVQLVQSGAEVKKPGASVKVSCKASGYTFTSDHISWVRQAPGQGLEWMGWISPHHGKTNYAQKLQGRVTMTTDTSTSTAYMELRSLRSDDTAVYYCARVQMDSEYYDLLTGINVGPYYFDYWGRGTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1066 - protein, 251 aa, Homo sapiens
HVQLQQSGAEVKKPGASVKVSCKASKYTFANHYIHWVRQAPGEGLEWMGNINPSGSSTRYAQRFQGRVTMTRDTSTSTVYMELSNLRSDDTAVYYCARATYDPLTGYSFDGFDIWGKGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1067 - protein, 251 aa, Homo sapiens
  Site (195): Xaa equals any of the naturally occurring L-amino acids
QVQLQQSGAEVKKPGASVKVSCKASKYTFANHYIHWVRQAPGEGLEWMGNINPSGSSTRYAQRFQGRVTMTRDTSTSTVYMELSNLRSDDTAVYYCARATYDPLTGYSFDGFDIWGKGTLVTVSSGGGGSGGGGSGGGGSQSVLTQPASVSGSPGQSITISCTGTSSDVGGYNYVSWYQQHPGKAPKLMIYEGSXRPSGVSNRFSGSKSGNTASLTISGLQAEDEADYYCSSYTTRSTRVFGGGTKLTVLG

SEQ ID NO: 1068 - protein, 251 aa, Homo sapiens
  Site (31): Xaa equals any of the naturally occurring L-amino acids
QVQLQQSGAEVKKPGASVKVSCKASGYTFTXYTMHWVRQAPGQGPEWMGWINGGSGDTKYSRKFQGRVTITKDTSASAAYMELSSLGSEDTALYYCARATYDPLTGYSFDGFDIWGQGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1069 - protein, 253 aa, Homo sapiens
GQLQQSGAEVKKPGASVKVSCKASGYTFTKYTMHWVRQAPGQGPEWMGWVNGGSGDTKYSRKFQGRVTITKDTSASAAYMELSSLGSEDTALYYCARATYDPLTGYSFDGLDIWGQGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEEAEDEADYYCSSYTTRSTRVFGGGTKLTVLG

SEQ ID NO: 1070 - protein, 251 aa, Homo sapiens
  Site (1): Xaa equals any of the naturally occurring L-amino acids
XVQLQQSGAEVKKPGASVTVSCRASGYNFITYGIHWVRQAPGQGPEWMGWINPGTGNTGSSQKFNHRVTITRDTSATTAYMEMRSLRSEDTALYYCARATYDPLTGYSFDGFDIWGQGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1071 - protein, 251 aa, Homo sapiens
QVQLQQSGAEVKKPGASVKVSCKASGYTFTSYAMHWVRQAPGQRLEWMGWINAGNGNTKYSQKFQGRVTITKDTSASAAYMELSSLGSEDTALYYCARATYDPLTGYSFDGFDIWGRGTLVTVSSGGGGSGGGGSGGGGSQSVLTQPASVSGSPGQSITISCTGTSSDVGGYNYVSWYQQHPSKAPKLMIYEGSKRPSGVSNRFSGSKSGNTASLTISGLQAEDEADYYCSSYTTRSTRVFGGGTKLTVLG

SEQ ID NO: 1072 - protein, 251 aa, Homo sapiens
EVQLVQSGAELKKPGSSVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGRGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1073 - protein, 251 aa, Homo sapiens
QVQLQQSGAEVKKPGASVKVSCKASGYTFTKYTMHWVRQAPGQGPEWMGWINGGSGDTKYSRKFQGRVTITKDTSASATYMELSSLGSEDTALYYCARATYDPLTGYSFDGFDIWGKGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1074 - protein, 251 aa, Homo sapiens
QVQLQQSGAEVKKPGASVNVSCKASGYTFTKYTMHWVRQAPGQGPEWMGWINGGSGDTKYSRKFQGRVTITKDTSASAAYMELSSLGSEDTALYYCARATYDPLTGYSFDGFDIWGQGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1075 - protein, 254 aa, Homo sapiens
GVQLVQSGGGVVQPGMSLIVSCAASGFTFSSYAMHWVRQAPGKGLEWVAVLSYDGDNKYYADSVKGRFTISRDNSKNTLYLQMNSLRAEDTAVYYCAREGSYDILTGYYVGVGRMDVWGKGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSNTTKSTRVFGGGTKLTVLG

SEQ ID NO: 1076 - protein, 251 aa, Homo sapiens
EVQLVQSGAEVKKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGRGTLVTVSSGGGGSGGGGSGGGGSQSVLTQPASVSGSPGQSITISCTGTSSDVGGYNYVSWYQQHPGRAPKLMIYEGSKRPSGVSNRFSGSKSGNTASLTISGLQAEDEADYYCSSYTTRSTRVFGGGTKLTVLG

SEQ ID NO: 1077 - protein, 251 aa, Homo sapiens
QVQLQQSGAEVKKPGASVKVSCKASGYTFTSYAIHWVRQAPGQRLEWMGWINANNGNTKHSQKFQGRVTITRDTSASTAYMELSSLRSEDTAIYYCARATYDPLTGYSFDGFDIWGKGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1078 - protein, 251 aa, Homo sapiens
QVQLQQSGAEVKKPGASVMVSCKASGYTFTKYTMHWVRQAPGQGPEWMGWINGGSGDTKYSRKFQGRVTITKDTSASAAYMELSSLGSEDTALYYCARATYDPLTGYSFDGFDIWGQGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTILG

SEQ ID NO: 1079 - protein, 251 aa, Homo sapiens
  Site (31): Xaa equals any of the naturally occurring L-amino acids
  Site (53): Xaa equals any of the naturally occurring L-amino acids
  Site (62): Xaa equals any of the naturally occurring L-amino acids
  Site (68): Xaa equals any of the naturally occurring L-amino acids
  Site (76): Xaa equals any of the naturally occurring L-amino acids
QVQLQQSGAEVKKPGASVIVSCKASGYTFTXYTMHWVRQAPGQGPEWMGWINXGSGDTKYSXKFQGRXTITKDTSXSATYMELSSLGSEDTALYYCARATYDPLTGYSFDGFDIWGKGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1080 - protein, 251 aa, Homo sapiens
QVQLQQSGAEVKKPGASVMVSCKASKYTFANHYIHWVRQAPGEGLEWMGNINPSGSSTRYAQRFQGRVTMTRDTSTSTVYMELSNLRSDDTAVYYCARATYDPLTGYSFDGFDIWGKGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1081 - protein, 251 aa, Homo sapiens
QVQLQQSGAEVKKPGSSVMVSCKASKYTFANHYIHWVRQAPGEGLEWMGNINPSGSSTRYAQRFQGRVTMTRDTSTSTVYMELSNLRSDDTAVYYCARATYDPLTGYSFDGFDIWGKGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1082 - protein, 251 aa, Homo sapiens
QVQLQQSGAEVKKPGASVIVSCKASGYTFTKYTMHWVRQAPGQGPEWMGWINGGSGDTKYSRKFQGRVTITKDTSASAAYMELSSLGSEDTALYYCARATYDPLTGYSFDGFDIWGRGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1083 - protein, 251 aa, Homo sapiens
QVQLQQSGAEVKKPGASVKVSCKASKYTFANHYIHWVRQAPGEGLEWMGNINPSGSSTRYAQRFQGRVTMTRDTSTSTVYMELSNLRSDDTAVYYCARATYDPLTGYSFDGFDIWGKGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSNTTRSTRVFGGGTKLTVLG

SEQ ID NO: 1084 - protein, 251 aa, Homo sapiens
QVQLQQSGAEVKKPGASVKVSCKASGYTFTNHSMHWVRQAPGQGPEWMGWINRGGSDTQYSQKFQGRVTITRDTSASAAYMELSSLGSDDTAVYYCARATYDPLTGYSFDGFDIWGQGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1085 - protein, 251 aa, Homo sapiens
GVQLVQSGAEVKKPGASVMVSCKASGYTFTKYTMHWVRQAPGQGPEWMGWINGGSGDTKYSRKFQGRVTITKDTSASAAYMELSSLGSEDTALYYCARATYDPLTGYSFDGFDIWGQGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1086 - protein, 251 aa, Homo sapiens
EVQLQQSGAEVKKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGRGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1087 - protein, 254 aa, Homo sapiens
QVQLQESGAEVKKSGESLKISCKASGYIFTDYWIGWVRQTPGKGLEWMGWINPNNGGTKYAQNFQGRVTMTRDTSVSTAYMELSRLRSDDTAVYYCARERHYYDILTGYQTGYGMDVWGRGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSNTTRSTRVFGGGTKLTVLG

SEQ ID NO: 1088 - protein, 254 aa, Homo sapiens
QVQLQESGAEVKKSGESLKISCKASGYIFTDYWIGWVRQTPGKGLEWMGWINPNNGGTKYAQNFQGRVTMTRDTSVSTAYMELSRLRSDDTAEYYCARERHYYDILTGYQTGYGMDVWGRGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1089 - protein, 253 aa, Homo sapiens
QVQQSGAEVKKPGGSLRLSCAASGFTFSSYSMNWVRQAPGKGLEWVSSISSSSSYIYYADSVKGRFTISRDNAKNSLYLQMNSLRAEDTAVYYCAREGGNYDILTGYYIGNGAFDIWGRGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTKSTRVFGGGTKLTVLG

SEQ ID NO: 1090 - protein, 247 aa, Homo sapiens
EVQLVQSGAEVKNPGSSVKVSCQAFGGSFSRYAISWVRQAPGQGLEWMGRIIPIVATPNYAQRFQGRITISADTLTSTAFMELSSLRSEDTAVYYCARDRETKVGYGMDVWGRGTMVTVSSGGGGSGGGGSGGGGSQSVLTQPPSASGTPGQRVTISCSGSSSNIGSNTVNWYQRLPGAAPQLLIYNNDQRPSGIPDRFSGSKSGTSGSLVISGLQSEDEADYYCASWDDSPNGRVFGGGTKLTVLG

SEQ ID NO: 1091 - protein, 253 aa, Homo sapiens
QVQQSGAEVKKPGGSLRLSCAASGFTFSSYSMNWVRQAPGKGLEWVSSISSSSSYIYYADSVKGRFTISRDNAKNSLYLQMNSLRAEDTAVYYCAREGGNYDILTGYYIGNGAFDIWGRGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGTTASLTISGLQAEDEADYYCSSYTTRSTRVYGGGTKLTVLG

SEQ ID NO: 1092 - protein, 253 aa, Homo sapiens
QVQQSGAEVKKPGGSLRLSCAASGFTFSSYSMNWVRQAPGKGLEWVSSISSSSSYIYYAYSVKGRFTISRDNATNSLYLQMNSLRAEDTDVYYCAREGGNYDILTGYYIGNGAFDIWGRGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1093 - protein, 253 aa, Homo sapiens
QVQQSGAEVKKPGGSLRLSCASSGFTFSSYSMNWVRQAPGKGLEWVSSISSSSSYIYYADSVKGRFTISRDNAKNSLYLQMNSLRAEDTAVYYCAREGGNYDILTGYYIGNGAFDIWGRGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1094 - protein, 253 aa, Homo sapiens
QVQQSGAEVKKPGGSLRLSCAASGFTFSSYSMNWVRQAPGKGLEWVSSISSSSSYIYYADSVKGRFTISRDNAKNSLYLQMNSLRAEDTAVYYCAREGGNYHILTGYYIGNGAFDIWGRGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1095 - protein, 253 aa, Homo sapiens
QVQQSRAEAKKPGGSLRLSCACSGFTFSSYSMNWVRQAPGKGLERVSSISSSSSYIYYAYSQNGQFTISRDNATNSLYLQMNSLRAEDTDVYYCAREGENYDILTGYYIGNGAFDIWSRGTMVTVSSGGGGSGGGGSGGGGSQSVLTQPASVSGSPGQSITISCTGTSSDVGGYNYVSWYQHHPGKAPKLMIYEGSKRPSGVSNRFSGSKSGNTASLTISGLQAEDEADYYCSSYTTRSTRVFGGGTKLTVLG

SEQ ID NO: 1096 - protein, 253 aa, Homo sapiens
QVQQAGAEVKKPGGSLRLSCAASGFTFSSYSMNWVRQAPGKGLEWVSSISSSSSYIYYADSVKGRFTISRDNAKNSLYLQMNSLRAEDTAVYYCAREGGNYDILTGYYIGNGAFDIWGRGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1097 - protein, 253 aa, Homo sapiens
QVQQSGAEVKKPGGSLRLSCAASGFTFSSYSMNWVRQAPGKGLEWVSSISSSSSYIYYADSVKGRFTISRDNAKNSLYLQMNSLRAEDTAVYYCAREGGNYDILTGYYIGNGAFDIWGRGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTGLG

SEQ ID NO: 1098 - protein, 253 aa, Homo sapiens
QVQQSGAEVKKPGGSLRLSCAASGFTFSSYSMNWVRQAPGKGLEWVSSISSSSSYIYYADSVKGRFTISRDNAKNSLYLQMNSLRAEDTAVYYCAREGGNYDILTGYYIGNGAFDIWGRGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEAEYYCSSYTTRSTRVFGGGTKLTVLG

SEQ ID NO: 1099 - protein, 247 aa, Homo sapiens
EVQLVQSGAEVKNPGSSVKVSCQASGGSFSRYAISWVRQAPGQGLEWMGRIIPIVATPNYAQRFQGRITISADTLTSTAFMELSSLRSEDTAVYYCARDRETKVGYGMDVWGRGTMVTVSSGGGGSGGGGSGGGGSQSVLTQPPSASGTPGQRVTISCSGSSSNIGSNTVIWYQRLPGAAPQLLIYNNDQRPSGIPDRFSGSKSGTSGSLVISGLQSEDEADYYCASWDASPNGRVFGGGTKLTVLG

SEQ ID NO: 1100 - protein, 253 aa, Homo sapiens
LVQQSGAEVKKPGGSLRLSCAASGFTFSSYSMNWVRQAPGKGLEWVSSISSSSSYIYYADSVKGRFTISRDNAKNSLYLQMNSLRAEDTAVYYCAREGGNYDILTGYYIGNGAFDIWGRGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1101 - protein, 253 aa, Homo sapiens
QVQQSGAEVKKPGGSLRLSCAASGFTFSSYSMNWVRQAPGKGLEWVSSISSSSSYIYYADSVKGRFTISRDNAKNSLYLQMNSLRAEDTDVYYCAREGGNYDILTGYYIGNGAFDIWGRGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1102 - protein, 249 aa, Homo sapiens
EVNLRESGGGVVQPGRSLRLSCAASGFTFSSYGMHWVRQAPGKGLEWVAVISYDGSNKYYADSVKGRFTISRDNSKNTLYLQMNSLRAEDTAVYYCAKDGYYDILTGYSYYGMDVWGQGTMVTVSSGGGGSGGGGSGGGGSSELTQDPAVSVALGQTVRITCQGDSLRSYYTNWFQQKPGQAPLLVVYAKNKRPSGIPDRFSGSSSGNTASLTISGAQAEDEADYYCNSRDSSGNHVVFGGGTKLTVLG

SEQ ID NO: 1103 - protein, 251 aa, Homo sapiens
QVQLVQSGAEVKKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGKGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1104 - protein, 248 aa, Homo sapiens
EVQLVQSGAEVKKPGASVKVSCKASGYTFTSYGISWVRQAPGQGLEWMGWISAYNGNTNYAQKFQGRVTITADESTSTAYMELSSLRSEDTAVYYCARMEYDILTGYYGGYFDYWGQGTMVTVSSGGGGSGGGGSGGGGSDVVMTQSPSSLSASLGDRVTITCRASQDITNDLAWYQQKPGKAPKLLIYGASTLQYGVPTRFSGSGSGTNFSLTISSLQPEDFATYFCQQSHSFPPTFGGGTKLEIKR

SEQ ID NO: 1105 - protein, 249 aa, Homo sapiens
QVNLRESGGGLVQPGGSLRLSCAASGFTFSSYGMHWVRQAPGKGLEWVAVISYDGSNKYYADSVKGRFTISRDNSKNTLYLQMNSLRAEDTAVYYCAKDGYYDILTGYSYYGMDVWGQGTLVTVSSGGGGSGGGGSGGGGSSELTQDPAVSVALGQTVRITCQGDSLRSYYTNWFQQKPGQAPLLVVYAKNKRPSGIPDRFSGSSSGNTASLTITGAQAEDEADYYCNSRDSSGNHVVFGGGTKLTVLG

SEQ ID NO: 1106 - protein, 251 aa, Homo sapiens
EVQLVQSGAEVKKPGASVKVSCKASGYTFTKYTMHWVRQAPGQGPEWMGWINGGSGDTKYSRKFQGRVTITKDTSARAAYMELSSLGSEDTALYYCARATYDPLTGYSFDGFDIWGQGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1107 - protein, 251 aa, Homo sapiens
QVQLQQSGAEVKKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGKGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1108 - protein, 249 aa, Homo sapiens
EVNLRESGGGVVQPGRSLLLSCAASGFTFSSYGMHWVRQAPGKGLEWVAVISYDGSNKYYADSVKGRFTISRDNSKNTLYLQMNSLRAEDTAVYYCAKDGYYDILTGYSYYGMDVWGQGTMVTVSSGGGGSGGGGSGGGGSSELTQDPAVSVALGQTVRITCQGDSLRSYYTNWFQQKPGQAPLLVVYAKNKRPSGIPDRFSGSSSGNTASLTITGAQAEDEADYYCNSRDSSGNHVVFGGGTKLTVLG

SEQ ID NO: 1109 - protein, 249 aa, Homo sapiens
QVQLVESGGGVVQPGRSLRLSCAASGFTFSSYGMHWVRQAPGKGLEWVAVISYDGSNKYYVDSVKGRFTISRDNSKNTLYLQMNSLRAEDTAVYYCARASYYDILTGYYKGAFDIWGQGTMVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1110 - protein, 249 aa, Homo sapiens
DVNLRESGGGVVQPGRSLRLSFAASGFTFSSYGMHWVRQAPGKGLEWVAVISYDGSNKYYADSVKGRFTISRDNSKNTLYLQMNSLRAEDTAVYYCAKDGYYDILTGYSYYGMDVWGQGTMVTVSSGGGGSGGGGSGGGGSSELTQDPAVSVALGQTVRITCQGDSLRSYYTNWFQQKPGQAPLLVVYAKNKRPSGIPDRFSGSSSGNTASLTITGAQAEDEADYYCNSRDSSGNHVVFGGGTKLTVLG

SEQ ID NO: 1111 - protein, 249 aa, Homo sapiens
EVNLRESGGGVVQPGRSLLLTCAASGFTFSSYGMHWVRQAPGKGLEWVAVISYDGSNKYYADSVKGRFTISRDNSKNTLYLQMNSLRAEDTAVYYCAKDGYYDILTGYSYYGMDVWGQGTMVTVSSGGGGSGGGGSGGGGSSELTQDPAVSVALGQTVRITCQGDSLRSYYTNWFQQKPGQAPLLVVYAKNKRPSGIPDRFSGSSSGNTASLTITGAQAEDEADYYCNSRDSSGNHVVFGGGTKLTVLG

SEQ ID NO: 1112 - protein, 247 aa, Homo sapiens
QVQLVESGGGVVQPGRSLTLSCEASGFRFSDYPMHWIRQTPGKGPEWLAVISYNGRDTIYADSVRGRFTISRDDFTRTLFLHINSLRPDDTAIYYCAKGDYDILTGTYYYIDVWGRGTLVTVSSGGGGSGGGGSGGGGSSELTQDPAVSVALGQTVRITCQGDSLRSYYASWYQQKPGQAPELVIYGKNNRPSGIPDRFSGSSSGNTASLTITGAQAEDEADYYCDSRDSSGNHVVFGGGTKLTVLG

SEQ ID NO: 1113 - protein, 249 aa, Homo sapiens
FVNLRESGGGVVQPGRSLRLSCAASGFTFSSYGMHWVRQAPGKGLEWVAVISYDGSNKYYADSVKGRFTISRDNSKNTLYLQMNSLRAEDTAVYYCAKDGYYDILTGYSYYGMDVWGQGTMVTVSSGGGGSGGGGSGGGGSSELTQDPAVSVALGQTVRITCQGDSLRSYYTNWFQQKPGQAPLLVVYAKNKRPSGIPDRFSGSSSGNTASLTITGAQAEDEADYYCNSRDSSGNHVVFGGGTKLTVLG

SEQ ID NO: 1114 - protein, 251 aa, Homo sapiens
EVQLVESGGGVVQPGGSLRLSCAASGFTVNSYAMHWVRQAPGKGLQWVAVISYDGSKKYYADSVKGRFTVSRDNSKNTLYLQMNSLRAEDTAVYYCARSHYDILTGLNYWYFDLWGQGTTVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1115 - protein, 249 aa, Homo sapiens
EVNLRESGGGVVQPGRSLRLSCAASGFTFSSYGMHWVRQAPGKGLEWVAVISYDGSNKYYADSVKGRFTISRDNSKNTLYLQMNSLRAEDTAVYYCAKDGYYDILTGYSYYGMDVWGQGTMVTVSSGGGGSGGGGSGGGGSSELTQDPAVSVALGQTVRITCQGDSLRSYYTNWFQQKPGQAPLLVVYAKNKRPSGIPDRFSGSSSGNTASLTITGAQAEDEADYYCHSWDSSGNHVVFGGGTKLTVLG

SEQ ID NO: 1116 - protein, 247 aa, Homo sapiens
QVQLLQSAAEVKKPGASVKVSCKASGYTFTSYGISWVRQAPGQGLEWMGWISAYNGNTNYAQKLQGRVTMTTDTSTSTAYMELRSLRSDDTAVYYCARVYYDILTGYNLFFDYWGKGTMVTVSSGGGGSGGGGSGGGGSSELTQDPAVSVALGQTVRITCQGDSLRSYYTNWFQQKPGQAPLLVVYAKNKRPSGIPDRFSGSSSGNTASLTITGAQAEDEADYYCHSWDSSGNHVLFGGGTKLTVLG

SEQ ID NO: 1117 - protein, 249 aa, Homo sapiens
EVNLRESGGGVVQPGRSLRLSCAVSGFTFSSYGMHWVRQAPGKGLEWVAVISYDGSNKYYADSVKGRFTISRDNSKNTLYLQMNSLRAEDTAVYYCAKDGYYDILTGYSYYGMDVWGQGTMVTVSSGGGGSGGGGSGGGGSSELTQDPAVSVALGQTVRITCQGDSLRSYYTNWFQQKPGQAPLLVVYAKNKRPSGIPDRFSGSSSGNTASLTITGAQAEDEADYYCNSRDSSGNHVVFGGGTKLTVLG

SEQ ID NO: 1118 - protein, 249 aa, Homo sapiens
  Site (64): Xaa equals any of the naturally occurring L-amino acids
EVNLRESGGGVVQPGRSLRLSCAASGFTFSSYGMHWVRQAPGKGLEWVAVISYDGSNKYYADSXKGRFTISRDNSKNTLYLQMNSLRAEDTAVYYCAKDGYYDILTGYSYYGMDVWGQGTMVTVSSGGGGSGGGGSGGGGSSELTQDPAVSVALGQTVRITCQGDSLRSYYTNWFQQKPGQAPLLVVYAKNKRPSGIPDRFSGSSSGNTASLTITGAQAEDEADYYCNSRDSSGNHVVFGGGTKLTVLG

SEQ ID NO: 1119 - protein, 249 aa, Homo sapiens
EVNLRESGGGVVQPGRSLRLSCAASGFTFSSYGMHWVRQAPGKGLEWMAVISYDGSNKYYADSVKGRFTISRDNSKNTLYLQMNSLRAEDTAVYYCAKDGYYDILTGYSYYGMDVWGQGTMVTVSSGGGGSGGGGSGGGGSSELTQDPAVSVALGQTVRITCQGDSLRSYYTNWFQQKPGQAPLLVVYAKNKRPSGIPDRFSGSSSGNTASLTITGAQAEDEADYYCNSRDSSGNHVVFGGGTKLTVLG

SEQ ID NO: 1120 - protein, 249 aa, Homo sapiens
EVNLRESGGGVVQPGRSLRLSCAASGFTFSSYGMHWVRQAPGKGLEWVAVISYDGSNKYYAHSVKGRFTISRDNSKNTLYLQMNSLRAEDTAVYYCAKDGYYDILTGYSYYGMDVWGQGTMVTVSSGGGGSGGGGSGGGGSSELTQDPAVSVALGQTVRITCQGDSLRSYYTNWFQQKPGQAPLLVVYAKNKRPSGIPDRFSGSSSGNTASLTITGAQAEDEADYYCNSRDSSGNHVVFGGGTKLTVLG

SEQ ID NO: 1121 - protein, 251 aa, Homo sapiens
EVQLVQSGAEVKKPGSSVKVSCSFSGGSFNHAISWVRQAPGRGLEWMGGILPMYGTANYAQKFQGRVTITADKLTNTVYMDLSRLRYEDTAVYYCARELGSSIVGATTGALDMWGRGTMVTVSSGGGGSGGGGSGGGGSAQAVVIQEPSFSVSPGGTVTITCGLTSGSVTTSYYPTWYQQAPGQAPRTLIYSTKIRSSGVPDRFSGSIIGNKAALTITGAQADDESDYYCLLYMGSGTRVFGGGTKLTVLG

SEQ ID NO: 1122 - protein, 251 aa, Homo sapiens
QVQLVQSGAEVKKPGSSVKVSCRASGGSFNHAISWVRQAPGRGLEWMGGILPMYGTANYAQKFQGRVTITADKLTNTVYMDLSRLRYEDTAVYYCARELGLSIVGATTGALDMWGQGTLVTVSSGGGGSGGGGSGGGGSAQSVLTQPPSVSEAPRQRVTISCSGSASNVGNNAVNWYQQLPGKPPKLLIYYDDLLPSGVSDRFSGSKSGTSASLAISGLQSEDEADYYCATWDDRLNGWVFGGGTKVTVLG

SEQ ID NO: 1123 - protein, 249 aa, Homo sapiens
QVQLVQSGAEVKKPGSSVKVSCRASGGSFNHAISWVRQAPGRGLEWMGGILPMYGTANYAQKFQGRVTITADKLTNTVYMDLSRLRYEDTAVYYCARELGLSIVGATTGALDMWGQGTMVTVSSGGGGSGGGGSGGGGSAQAVLTQPSSVSVAPGETARVTCGGNNIGSKSVHWYQQQPGQAPVVVIYYDSDRPSGIPERFSGSNSGNTATLTISRVEAGDEADYYCQVWDSSSDLYVFGTGTKVTVLG

SEQ ID NO: 1124 - protein, 244 aa, Homo sapiens
QVQLVQSGAEVKKPGSSVKVSCKASGGTVSSRTISWVRQAPGQGLEWMGGSLPPSGAPIYAQKFQGRVAITADALTNTAFMELRSLKSDDTAVYYCARDQGRYLDLWGRGTLVTVSSGGGGSGGGGSGGGGSAQSVLTQPPSASGTPGQRVTISCSGSSSNIGTNTVNWYQHLPGTAPKLLIYNNNRRPSGVPDRFSGSKSGTSASLAISGLQSEDEADYYCAAWDDSLNAWVFGGGTKLTVLG

SEQ ID NO: 1125 - protein, 253 aa, Homo sapiens
LVQLVQSGAEVKKPGSPVWVFFKASGGTFTRYAISWVRQAPGQGLEWMGRIIPILGIANYAQKFQGRVTITADKLTSTVYMELSSLRSEDTAVYYCARDNYDILTGYSRRFDPWGQGTLVTVSSGGGGSGGGGSGGGGSALNFMLTQPHSVSESPGKTVTISCTRSSGNIASKYVQWYQQRPGSAPTTVIYENNRRPSGVPDRFSGSIDSSSNSASLTISGLKTEDEADYYCQSYDTSALYVFGTGTKLTVLG

SEQ ID NO: 1126 - protein, 251 aa, Homo sapiens
QVQLVQSGAEVKKPGSSVKVSCRASGGSFNHAISWVRQAPGRGLEWMGGILPMYGTANYAQKFQGRVTITADKLTNTVYMDLSRLRYEDTAVYYCARELGSSIVGATTGALDMWGRGTMVTVSSGGGGSGGGGSGGGGSAQAVVIQEPSFSVSPGGTVTITCGLTSGSVTTSYYPTWYQQAPGQAPRTLIYSTKIRSSGVPDRFSGSIIGNKAALTITGAQADDESDYYCLLYMGSGTRVFGGGTKLTVLG

SEQ ID NO: 1127 - protein, 251 aa, Homo sapiens
EVQLVQSGAEVKKPGSSVKVSCMSSGGSFNHAISWVRQAPGRGLEWMGGILPMYGTANYAQKFQGRVTITADKLTNTVYMDLSRLRYEDTAVYYCARELGSSIVGATTGALDMWGRGTMVTVSSGGGGSGGGGSGGGGSAQAVVIQEPSFSVSPGGTVTITCGLTSGSVTTSYYPTWYQQAPGQAPRTLIYSTKIRSSGVPDRFSGSIIGNKAALTITGAQADDESDYYCMLYMGSGTRVFGGGTKLTVVG

SEQ ID NO: 1128 - protein, 252 aa, Homo sapiens
EVQLVQSGAEVKKPGSSVKVSCRASGGSFNHAISWVRQAPGRGLEWMGGILPMYGTANYAQKFQGRVTITADKLTNTVYMDLSRLRYEDTAVYYCARELGLSIVGATTGALDMWGQGTMVTVSSGGGGSGGGGSGGGGSALSYELTQPPSMSGTPGQRVTISCSGSSSNTGSNTVNWYQQLPGTAPKVLIHSDNQRPSGVPDRFSGSKSGTSASLAISGLQSEDEADYYCAAWDDSLYGYVFGAGTKLTVLG

SEQ ID NO: 1129 - protein, 252 aa, Homo sapiens
EVQLVQSGAEVKKPGSSVKVSCQASGGTFSTHAINWVRQAPGQGLEWMGGIIPMSATTRYAQKFQGRLTIIADELTSTVHMELSSLRSEDTAVYYCARPLGITAVRGAKTDAFGIWGQGTMVTVSSGGGGSGGGGSGGGGSQSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLG

SEQ ID NO: 1130 - protein, 251 aa, Homo sapiens
QMQLVQSGAEVKKPGSSVKVSCRASGGSFNHAISWVRQAPGRGLEWMGGILPMYGTANYAQKFQGRVTITADKLTNTVYMDLSRLRYEDTAVYYCARELGLSIVGATTGALDMWGKGTLVTVSSGGGGSGGGGSGGGGSAQAVLTQPSSASGTPGQRVTMSCSGSSSNIGSNTVNWYQQLPGAAPKLLIYRSDQRSSGVPDRFSGSKSGTSASLAISGLQSEDEADYYCAAWDDSLDGYVFGTGTKLTVLG

SEQ ID NO: 1131 - protein, 252 aa, Homo sapiens
QVQLVQSGAEVKKPGSSVKVSCSASGGSFNHAISWVRQAPGRGLEWMGGILPMYGTANYAQKFQGRVTITADKLTNTVYMDLSRLRYEDTAVYYCARELGLSIVGATTGALDMWGKGTLVTVSSGGGGSGGGGSGGGGSALSYVLTQPPSASGTPGQRVTISCSGSSSNIGNNYVFWYQQLPGAAPKLLIYRNSQRPSGVPDRFSGSTSGTSASLAISGLRSEDEADYYCAARDDSLRGPVFGGGTKLTVLG

SEQ ID NO: 1132 - protein, 251 aa, Homo sapiens
EVQLVQSGAEVKKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGQGTLVTVSSGGGGSGGGGSGGGGSQSVLTQPASVSGSPGQSITISCTGTSSNVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1133 - protein, 251 aa, Homo sapiens
QVQLVQSGAEVKKPGSSVKVSCKASGGTFSSYAFNWVRRAPGQGLEWLGSIVPVFNTKTFARKFQGRVTLTADELTRTAYLELSNLRSDDTAVYYCASRYGDPFYYYYYMNVWGQGTMVTVSSGGGGSGGGGSGGGGSAQSVLTQPPSVSGAPGQRVTISCTGSSSNIGDGYDVHWYQQLPGTAPKLLIYGNTNRPSGVPDRFSGSKSDTSASLAITGLQVEDEADYFCHSYDSSLSGWIFGGGTKLTVLG

SEQ ID NO: 1134 - protein, 248 aa, Homo sapiens
EVQLVESGAEVKKPGSSVKVSCKASGGIFSSNGFSWVRQAPGQGLEWMGAIIPKFKTAHYAQNFQGRVTINADDLTRTVYMELSSLRSGDTAVYYCARGGSSQNFYGMDVWGRGTMVTVSSGGGGSGGGGSGGGGSAQPVLTQPPSASGTPGQRVTISCSGSSSNIGSNTVNWYQQVPGTAPKLLMYTNNQRPSGVPDRFSGSKSGTSASLAISGLQSEDEADYYCAAWDDSLNGWVFGGGTKVTVLG

SEQ ID NO: 1135 - protein, 252 aa, Homo sapiens
QVQLVQSGAEVKKPGSSVKVSCMASGGSFNHAISWVRQAPGRGLEWMGGILPMYGTANYAQKFQGRVTITADKLTNTVYMDLSRLRYEDTAVYYCARELGLSIVGATTGALDMWGKGTLVTVSSGGGGSGGGGSGGGGSALSYVLTQPPSASGTPGQRVTISCSGSSSNIGNNYVFWYQQLPGAAPKLLIYRNSQRPSGVPDRFSGSTSGTSASLAISGLRSEDEADYYCAARDDSLRGPVFGGGTKLTVLG

SEQ ID NO: 1136 - protein, 254 aa, Homo sapiens
QVQLVQSGAEVKKPGSSVKVSCRASGGSFNHAISWVRQAPGRGLEWMGGILPMYGTANYAQKFQGRVTITADKLTNTVYMDLSRLRYEDTAVYYCARELGLSIVGATTGALDMWGRGTLVTVSSGGGGSGGGGSGGGGSAQAVLTQPSSVSGTPGQTITISCTGSDSNIGAGYDVHWYQHLPGTAPKLLIYVNTNRPSGVPDRFSGSKSGTLASLVITGLQAEDEADYYCQSYDLSLTGRNYVFGSGTKLTVLG

SEQ ID NO: 1137 - protein, 255 aa, Homo sapiens
EVQLVQSGGGLIQPGGSLRLSCAASGFTVSNNYMSWVRQAPGKGLEWVSLIYSGGNTYYADSVKGRFTISRDNSKNTLYLQMNSLRAEDTAVYYCARAGSGFHDILTGYYKGGYFDYWGRGTLVTVSSGGGGSGGGGSGGGGSAQPVLTQPPSASGTPGQRVTISCSGSRSNIGSNTVSWFRQLPGAAPKLLIYTDTQRPSGVPDRVSGSRSGSSASLAISGLQSEDEADYHCAAWDDSLNGWVFGGGTKVTVLG

SEQ ID NO: 1138 - protein, 249 aa, Homo sapiens
QMQLVQSGAEVKKPGSSVKVSCQASGGNFNSYGVSWVRQAPGQGLEWMGRIIPNVGTANYAQKFQGRVTITADKLTSTVYLEVRSLRSEDTAVYYCARGDYDILTGYPAECFQIWGRGTLVTVSSGGGGSGGGGSGGGGSALSSELTQDPAVSVALGQAVRITCQGDSLRSFDASWYQQKPGQAPLLVIFSNTRRPSGIPDRFSGSISGNTASLTITGAQAEDEAAYYCCSRDSGDHVFGGGTKVTVLG

SEQ ID NO: 1139 - protein, 254 aa, Homo sapiens
EVQLVQSGGGVVQPGRSLRLSCAASGFTFRTHGMHWVRQAPGKGLEWVAGISYDGRYKYYADSVRGRFTISRDNSKNTVDLQMNSLRAEDTAVYYCAQGSVYDILTGTYYKSGMGVWGRGTLVTVSSGGGGSGGGGSGGGGSAQSVVTQPPSVSAAPGQMVTISCSGSSSNIGDNFVSWYQHLPGAAPKLLIYDNNKRPSGIPDRFSGSKSGTSATLGITGLQTGDEADYYCGTWDSSLNAGVFGGGTKLTVLG

SEQ ID NO: 1140 - protein, 251 aa, Homo sapiens
EVQLVQSGAEVKKPGSSVKVFCRASGGSFNHAISWVRQAPGRGLEWMGGILPMYGTANYAQKFQGRVTITADKLTNTVYMDLSRLRYEDTAVYYCARELGSSIVGATTGALDMWGRGTMVTVSSGGGGSGGGGSGGGGSAQAVVIQEPSFSVSPGGTVTITCGLTSGSVTTSYYPTWYQQAPGQAPRTLIYSTKIRSSGVPDRFSGSIIGNKAALTITGAQADDESDYYCLLYMGSGTRVFGGGTKLTVLG

SEQ ID NO: 1141 - protein, 251 aa, Homo sapiens
EVQLVQSGAEVKKPGSSVKVSCRASGGSFNHAISWVRQAPGRGLEWMGGILPMYGTANYAQKFQGRVTITADKLTNTVYMDLSRLRYEDTAVYYCARELGSSIVGATTGALDMWGRGTMVTVSSGGGGSGGGGSGGGGSAQAVVIQEPSFSVSPGGTVTITCGLTSGSVTTSYYPTWYQQAPGQAPRTLIYSTKIRSSGVPDRFSGSIIGNKAALTITGAQADDESDYYCMLYMGSGTRVFGGGTKLTVLG

SEQ ID NO: 1142 - protein, 249 aa, Homo sapiens
EVQLVQSGAEVKKPGSSVKVSCRASGGSFNHAFNWVRRAPGQGLEWLGSIVPVFNTKTFTRKFQGRVTLTADELTRTAYLELSNLRSDDTAVYYCASRYGDPFYYYYYMNVWGRGTMVTVSSGGGGSGGGGSGGGGSAQAVLTQPSSVSGAPGQRVTISCTGSNSNIGAGYDVHWYQHLPGTAPKLLIYGNNNRPSGVPDRFSGSKSGTSASLAITGLQAEDEADYYCQSYDTGLNVLFGAGTKVTVLG

SEQ ID NO: 1143 - protein, 251 aa, Homo sapiens
GVQLVQSGAEVKKPGASVKVSCKASGYTFANYAIHWVRQAPGQGPEWMGWINGGSGDTKYSRKFQGRVTITKDTSASAAYMELSSLGSEDTALYYCARATYDPLTGYSFDGFDIWGRGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1144 - protein, 252 aa, Homo sapiens
EVQLVQSGAEVKKPGSSVKVSCKASGGTFSSYAFNWVRRAPGQGLEWLGSIVPVFNTKTFARKFQGRVTLTADELTRTAYLELSNLRSDDTAVYYCASRYGDPFYYYYYMNVWGKGTLVTVSSGGGGSGGGGSGGGGSAQAVLTQPSSVSGAPGQRVTISCAGSSSNIGAGYDVHWYQQLPGTAPKLLIYGNNNRPSGVPDRFSGSKSGTSASLAITGLQAEDEADYYCQSYDSSLSGSTVFGTGTKLTVLG

SEQ ID NO: 1145 - protein, 252 aa, Homo sapiens
QVQLVQSGAEVKKPGSSVKVFCRASGGSFNHAISWVRQAPGRGLEWMGGILPMYGTANYAQKFQGRVTITADKLTNTVYMDLSRLRYEDTAVYYCARELGLSIVGATTGALDMWGKGTLVTVSSGGGGSGGGGSGGGGSALSYVLTQPPSASGTPGQRVTISCSGSSSNIGNNYVFWYQQLPGAAPKLLIYRNSQRPSGVPDRFSGSTSGTSASLAISGLRSEDEADYYCAARDDSLRDPIFGGETKLTVLD

SEQ ID NO: 1146 - protein, 251 aa, Homo sapiens
QVQLVQSGAEVKKPGASVKVSCKASGYTFTGYAMHWVRQAPGQRLEWMGWINAGNGNTKYSRKFQGRVTITRDTSASTAYMELSSLRSEDTAVYYCARGYDDILTGYIMALDYWGRGTLVTVSSGGGGSGGGGSGGGGSAQSVLTQPPSVSAAPGQRVTISCSGSSSNIGSHFVSWYQQFPGTAPHLLIYDNNKRPSGIPDRFSGSKSDTSATLDITGLQPGDEADYYCGTWDSSLTAWVFGGGTKVTVLG

SEQ ID NO: 1147 - protein, 251 aa, Homo sapiens
EVQLVQSGAEVKKPGSSVKVSCRASGGSFNHAISWVRQAPGRGLEWMGGILPMYGTANYAQKFQGRVTITADKLTNTVYMDLSRLRYEDTAVYYCARELGSSIVGATTGALDMWGRGTMVTVSSGGGGSGGGGSGGGGSAQAVVIQEPSFSVSPGGTVTITCGLTSGSVTTSYYPTWYQQAPGQAPRTLIFSTKIRSSGVPDRFSGSIIGNKAALTITGAQADDESDYYCLLYMGSGTRVFGGGTKLTVLG

SEQ ID NO: 1148 - protein, 251 aa, Homo sapiens
EVQLVQSGAEVKKPGSSVKVSCRAFGGSFNHAISWVRQAPGRGLEWMGGILPMYGTANYAQKFQGRVTITADKLTNTVYMDLSRLRYEDTAVYYCARELGSSIVGATTGALDMWGRGTMVTVSSGGGGSGGGGSGGGGSAQAVVIQEPSFSVSPGGTVTITCGLTSGSVTTSYYPTWYQQAPGQAPRTLIYSTKIRSSGVPDRFSGSIIGNKAALTITGAQADDESDYYCLLYMGSGTRVFGGGTKLTVLG

SEQ ID NO: 1149 - protein, 251 aa, Homo sapiens
EVQLVQSGAEVKKPGSSVKVSCRASGGSFNHAISWVRQAPGRGLEWMGGILPMYGTANYAQKFQGRVTITADKLTNTVYMDLSRLRYEDTAVYYCARELGSSIVGATTGALDMWGRGTMVTVSSGGGGSGGGGSGGGGSAQAVVIQEPSFSVSPGGTVTITCGLTSGSVTTSYYPTWYQQAPGQAPRTLIYSTKIRSSGVLIGSLASIIGNKAALTITGAQADDESDYYCLLYMGSGTRVFGGGTKLTVLG

SEQ ID NO: 1150 - protein, 256 aa, Homo sapiens
EVQLVQSGAEVKKPGSSLKLSCRASGGSFNHAISWVRQAPGRGLEWMGGILPMYGTANYAQKFQGRVTITADKLTNTVYMDLSRLRYEDTAVYYCARELGSSIVGATTGALDMWGRGTMVTVSSGGGGSGGGGSGGGGSAQAVRTQPSSLYASPVASSSLTCASLSGINAGTLGIYWYQQKPGSPPQYLVSCKSVSDKQQGSGVPSRFFGSKDASANAGISIISGLQSEDEADYYCMIRHSSASVFGGGTKLTVLG

SEQ ID NO: 1151 - protein, 251 aa, Homo sapiens
EVQLVQSGAEVKKPGSSVKVSCRASGGSFNHAISWVRQAPGRGLEWMGGILPMYGTANYAQKFQGRVTITADKLTNTVYMDLSRLRYEDTAVYYCARELGSSIVGATTGALDMWGRGTMVTVSSGGGGSGGGGSGGGGSAQAVVIQEPSFSVSPGGTVTITCGLTSGSVTTSYYPTWYQQAPGQAPRTLIYSTKIRSSGVPDRFSGSIIGNKAALTITGAQADDESDYFSLLYMGSGTRVFGGGTKLTVLG

SEQ ID NO: 1152 - protein, 251 aa, Homo sapiens
EVQLVQSGAEVKKPGSSLKLSCRASGGSFNHAISWVRQAPGRGLEWMGGILPMYGTANYAQKFQGRVTITADKLTNTVYMDLSRLRYEDTAVYYCARELGSSIVGATTGALDMWGRGTMVTVSSGGGGSGGGGSGGGGSAQAVVIQEPSFSVSPGGTVTITCGLTSGSVTTSYYPTWYQQAPGQAPRTLIYSTKIRSSGVPDRFSGSIIGNKAGLTITGAQADDESDYYWLLYMGSGTPVFGGGTKLTVLG

SEQ ID NO: 1153 - protein, 255 aa, Homo sapiens
QVQLVESGPEVKKPGASVKVSCEASAELFASSDINWVRQATGQGLEWMGWVNPSSGNAGYAEKFEGRVSMTTNIPKKTVYMELSSLTSEDTAVYYCARGTGYDILTGYYMGSAFDQWGKGTMVTVSSGGGGSGGGGSGGGGSAQAVLTQPSSVSGAPGQRVTISCTGSSSNIGAGYDVYWYQQLPGTAPKLLIYRNNNRPSGVPDRFSGSKSGTSASLAITGLQAEDEADYYCQSYDSSLSEEVFGGGTKVTVLG

SEQ ID NO: 1154 - protein, 251 aa, Homo sapiens
EVQLVQSGAEVKKPGSSVKVSCKASGGTFSSYAFNWVRRAPGQGLEWLGSIVPVFNTKTFARKFQGRVTLTADELTRTAYLELSNLRSDDTAVYYCASRYGDPFYYYYYMNVWGRGTMVTVSSGGGGSGGGGSGGGGSAQAVLTQPSSVSGAPGQRVTISCTGSSSNIGDGYDVHWYQQLPGTAPKLLIYGNSNRPSGVPDRFSGSKSDTSASLAITGLQVKDEADYFCHSYDSSVSGWIFGGGTKPTVLG

SEQ ID NO: 1155 - protein, 251 aa, Homo sapiens
QVQLVQSGAEVKKPGSSVKVSCRASGGSFNHAISWVRQAPGRGLEWMGGILPMYGTANYAQKFQGRVTITADKLTNTVYMDLSRLRYEDTAVYYCARELGLSIVGATTGALDMWGRGTLVTVSSGGGGSGGGGSGGGGSAQAVLTQPSSVSGTPGQRVTISCSGARSNIGSNTVNWYQHFPGTAPKLVMYSNDQRPSGVPARFSGSRSGTSASLAIGRLQSEDEADYYCAAWDDSLNGPVFGGGTKLTVLG

SEQ ID NO: 1156 - protein, 255 aa, Homo sapiens
QVQLQQSGAEVKKPGASVKVSCKASGYTFTSYYMHWVRQAPGQGLEWMGIINPSGGSTSYAQKFQGRVTMTRDTSTSTVYMELSSLRSEDTAVYYCARGGEYDILTGYYFGLGVYDYWGQGTMVTVSSGGGGSGGGGSGGGGSAQSVLTQPPSVSAAPGQKVTISCSGSISNIGNKYVSWYQQLPGTAPKLLIYDNDKRPSGIPDRFSGSKSGTSATLGITGLQTGDEADYYCGTWDSSLSAGVFGGGTKLTVLG

SEQ ID NO: 1157 - protein, 251 aa, Homo sapiens
EVQLVQSGAEVKKPGSSVKVSCRASGGSFNHAISWVRQAPGRGLEWMGGILPMYGTANYAQKFQGRVTITADKLTNTVYMDLSRLRYEDTAVYYCARELGSSIVGATTGALDMWGTGTMVTVSSGGGGSGGGGSGGGGSAQAVVIQEPSFSVSPGGTVTITCGLTSGSVTTSYYPTWYQQAPGQAPRTLIYSTKIRSSGVPDRFSGSIIGNKAALTITGAQADDESDYYCLLYMGSGTRVFGGGTKLTVLG

SEQ ID NO: 1158 - protein, 250 aa, Homo sapiens
QVQLVQSGAEVKKPGSSVKVSCKASGGTFSSYAFNWVRRAPGQGLEWLGSIVPVFNTKTFARKFQGRVTLTADELTRTAYLELSNLRSDDTAVYYCASRYGDPFYYYYYMNVWGRGTLVTVSSGGGGSGGGGSGGGGSAQSVLTQPPSASGTPGQRVTISCSGSRSSIGSNTVNWYQQFPGTAPKLLIYGDDQRPSGVPDRFSGSKSGTSASLAISGLQSEDEADYHCAAWDDSLSGYVFGTGTKLTVLG

SEQ ID NO: 1159 - protein, 250 aa, Homo sapiens
ESSWCSLGLRVKKPGSSVKVSCRAFGGSFNHAISWVRQAPGRGLEWMGGILPMYGTANYAQKFQGRVTITADKLTNTVYMDLSRLRYEDTAVYYCARELGSSIVGATTGALDMWGRGTMVTVSSGGGGSGGGGSGGGGSAQAVVIQEPSFSVSPGGTVTITCGLTSGSVTTSYYPTWYQQAPGQAPRTLIYSTKIRSSGVLIGSLAPSLGTSCLTITGAQADDESDYYWLLYMGSGTRVFGGGTKLTVLG

SEQ ID NO: 1160 - protein, 249 aa, Homo sapiens
EVQLVQSGAEVKKPGSSGGAAGLLEAPSTMLLAGCDRPRDEGLSGWEGSSLCMVQQIMHRSSRAEHDHRGQINEHSYMDLSRLRYEDTAVYYCARELGSSIVGATTGALDMWGRGTMVTVSSGGGGSGGGGSGGGGSAQAVVIQEPSFSVSPGGTVTITCGLTSGSVTLVTTPLGTSRPQARLHVHSFTVQRFALLGSLIGSLAPSLGTKLPSPSRGPRQMMNLIITVCSPVGSGTRVFGGGTKLTVLG

SEQ ID NO: 1161 - protein, 250 aa, Homo sapiens
QVQLVQSGAEVKKRGASVKVSCKASGYTFTGHYMHWVRQAPGQGLEWMGWINPNNGGTNYAQNLQGRATFTRDTSISTAYMELSGLKSDDSAVYYCARDPFGAVPGYYYYAMDVWGQGTMVTVSSGGGGSGGGGSGGGGSAQSVLTQPPSVSVAPGQTARIPCGGTNIGSKSVHWYQQKPGQAPVLVVFDDSDRPSGIPDRFSGSNSGNTATLTISRVEAGDEADYYCQVWDILTDHVLFGGGTKLTVLG

SEQ ID NO: 1162 - protein, 251 aa, Homo sapiens
EVQLVQSGAEVKKPGSSVKVSCRAIGGSFNHAISWVRQAPGRGLEWMGGILPMYGTANYAQKFQGRVTITADKLTNTVYMDLSRLRYEDTAVYYCARELGSSIVGATTGALDMWGRGTMVTVSSGGGGSGGGGSGGGGSAQAVVIQEPSFSVSPGGTVTITCGLTSGSVTTSYYPTWYQQAPGQAPRTLIYSTKIRSSGVPDRFSGSIIGNKAALTITGAQADDESDYYCLLYMGSGTRVFGGGTKLTVLG

SEQ ID NO: 1163 - protein, 252 aa, Homo sapiens
QVQLVQSGAEVKKPGSSVKVSCRAFGGSFNHAISWVRQAPGRGLEWMGGILPMYGTANYAQKFQGRVTITADKLTNTVYMDLSRLRYEDTAVYYCARELGLSIVGATTGALDMWGKGTLVTVSSGGGGSGGGGSGGGGSALSYVLTQPPSASGTPGQRVTISCSGSSSNIGNNYVFWYQQLPGAAPKLLIYRNSQRPSGVPDRFSGSTSGTSASLAISGLRSEDEADYYCAARDDSLRGPVFGGGTKLTVLG

SEQ ID NO: 1164 - protein, 252 aa, Homo sapiens
QVQLQQSGPEVKKPGASVKVSCQASGYNFGDHGISWVRQAPGQGLEWMGWMSNYSGKTKYEQRFQGRVTMTADTSTSTAFMELTSLRFNDTAVYYCARGPWYDPLFPPSGRHYGLDVWGRGTLVTVSSGGGGSGGGGSGGGGSAQSVVTQPPSVSGAPGQRVTISCSGSEARFGVQWYQQIPGTAPKLLIYDNNNRPSGVPDRISGSRSGNSASLAISGLQTEDEADYYCQSYDSLLGGWVFGGGTKVTVLG

SEQ ID NO: 1165 - protein, 254 aa, Homo sapiens
QVQLVQSGAEVKKPGSSVKVSCRAFGGSFNHAISWVRQAPGRGLEWMGGILPMYGTANYAQKFQGRVTITADKLTNTVYMDLSRLRYEDTAVYYCARELGLSIVGATTGALDMWGRGTLVTVSSGGGGSGGGGSGGGGSAQAVLTQPSSVSGTPGQTITISCTGSDSNIGAGYDVHWYQHLPGTAPKLLIYVNTNRPSGVPDRFSGSKSGTLASLVITGLQAEDEADYYCQSYDLSLTGRNYVFGSGTKLTVLG

SEQ ID NO: 1166 - protein, 251 aa, Homo sapiens
  Site (230): Xaa equals any of the naturally occurring L-amino acids
EVQLVQSGAEVKKPGSSVKVSCRASGGSFNHAISWVRQAPGRGLEWMGGILPMYGTANYAQKFQGRVTITADKLTNTVYMDLSRLRYEDTAVYYCARELGSSIVGATTGALDMWGRGTMVTVSSGGGGSGGGGSGGGGSAQAVVIQEPSFSVSPGGTVTITCGLTSGSVTTSYYPTWYQQAPGQAPRTLIYSTKIRSSGVPDRFSGSIIGNKAALTITGAQADDESDYYXLLYMGSGTRVFGGGTKLTVLG

SEQ ID NO: 1167 - protein, 253 aa, Homo sapiens
EVQLVQSGAEVKKPGSPVRVSCKASGGTFTRYAISWVRQAPGQGLEWMGRIIPILGIANYAQKFQGRVTITADKLTSTVYMELSSLRSEDTAVYYCARDNYDILTGYSRRFDPWGQGTLVTVSSGGGGSGGGGSGGGGSALNFMLTQPHSVSESPGKTVTISCTRSSGNIASKYVQWYQQRPGSAPTTVIYENNRRPSGVPDRFSGSIDSSSNSASLTISGLKTEDEADYYCQSYKPAPFMSSELGPSMTVLG

SEQ ID NO: 1168 - protein, 250 aa, Homo sapiens
QVQLVQSGAEVKKPGSSVKVSCRASGGSFNHAISWVRQAPGRGLEWMGGILPMYGTANYAQKFQGRVTITADKLTNTVYMDLSRLRYEDTAVYYCARELGLSIVGATTGALDMWGRGTMVTVSSGGGGSGGGGSGGGGSALSSELTQDPAVSVALGQTVRITCQGDSLRSYHATWYQQKPGRAPILVMYETNKRPSGIPDRFYGSSSGNTASLIISGAQAEDEADYHCNSRDIASDHLIFGEGTKLTVLG

SEQ ID NO: 1169 - protein, 252 aa, Homo sapiens
QVQLVQSGPKVKKLGSSVKVSCQASGGNFNSYGVSWVRQAPGQGLEWMGRIIPNVGTANYAQKFQGRVTITADKLTSTVYLEVRSLRSEDTAVYYCARGDYDILTGYPAECFQIWGKGTLVTVSSGGGGSGGGGSGGGGSAQSVLTQPPSMSAAPGQVVTISCSGSSSNIGSNHVSWYRQFPGTAPKLIIYENLKRSPGIPDRLSGSKSGTSATLDITGLQTGDEADYYCASWDSSLSGAVFGGGTKLTVLG

SEQ ID NO: 1170 - protein, 250 aa, Homo sapiens
QVQLVQSGAEVKKPGESLKISCKGSGYSFSRYGISWVRQAPGQGLEWMGWISGYNGNTNYAQNFQGRATMTTDTSTSTAYMELRGLRSDDTAVYYCARDMYYDILTGYYTGLAFDMWGKGTMVTVSSGGGGSGGGGSGGGGSSELTQDPAVSVALGQTVRITCQGDSLRSYYTNWFQQKPGQAPLLVVYAKNKRPSGIPDRFSGSSSGNTASLTITGAQAEDEADYYCHSRDSSGNHVLFGGGTKLTVLG

SEQ ID NO: 1171 - protein, 251 aa, Homo sapiens
QVQLVESGGGLVQPGGSLRLSCAASGFTFSSFGMSWVRQAPGKGLEWVSTTSGTGGATYYADSVKGRFTISRDNSKNTLYLRMNSLRAEDTAVYYCAKVLNYDILTGYYYGMDVWGRGTMVTVSSGGGGSGGGGSGGGGSQSALTQPASVSGSRGQSITISCTGTTGDVGGYDYVSWYQQHPGKAPKLLIYGNSNRPSGVPDRFSASKSGNTASLTISGLQAEDEADYFCSTYAPPGIIMFGGGTKLTVLG

SEQ ID NO: 1172 - protein, 251 aa, Homo sapiens
EVQLVQSGAEVKKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGRGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1173 - protein, 258 aa, Homo sapiens
QVQLVESGGSLVQPGGSLRLSCAASGFTFSSYAMSWVRQAPGKGLEWVGFIRSKAYGGTTEYAASVKGRFTISRDDSKSIAYLQMNSLKTEDTAVYYCTRDFGYYDILTGYYIGAFYAFDIWGRGTMVTVSSGGGGSGGGGSGGGGSQSVLTQPPSASGSPGQSVTISCTGTSSDVGGYNYVSWYQQHPGKAPKFMIYDVSKRPSGVSNRFSGSKSGNTASLTISGVQAEDEADYYCSSYTSASTVIFGGGTKLTVLG

SEQ ID NO: 1174 - protein, 250 aa, Homo sapiens
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARGGHTCIIPTCHMGGWGQGTLVTVSSGGGGSGGGGSGGGGSEIVLTQSPFSLSASVGDRVTITCRASQSISSYLNWYQQKPGKAPKLLIYAASSLQSGVPSRFSGSGSGTNFTLTISSLQPEDFATYYCQQSYSTPPWTFGQGTKVDIKR

SEQ ID NO: 1175 - protein, 253 aa, Homo sapiens
QVQLVQSGAEVKKPGESLKISCKGSGYSFSRYGISWVRQAPGQGLEWMGWISGYNGNTNYAQNFQGRATMTTDTSTSTAYMELRGLRSDDTAVYYCARDMYYDILTGYYTGLAFDMWGRGTTVTVSSGGGGSGGGGSGGGGSQSVLTQPASVSGSPGQSITISCTGTSSDVGGHNYVSWYQQHPGKAPKLMIYEGSKRPSGVSNRFSGSKSGNTASLTISGLQAEDEADYYCSSYTTRSTRVFGGGTKLTVLG

SEQ ID NO: 1176 - protein, 251 aa, Homo sapiens
QVQLQQSGAEVKKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGQGTMVTVSSGGGGSGGGGSGGGGSQSVLTQPASVSGSPGQSITISCTGTSSDVGGYNYVSWYQQHPGKAPKLMIYEGGKRPSGVSNRFSGSKSGNTASLTISGLQAEDEADYYCSSYTTRSTRVFGGGTKLTVLG

SEQ ID NO: 1177 - protein, 247 aa, Homo sapiens
EVQLVQSGGGLVQPGGSLRLSCAASGFTFSSYALHWVRQAPGKGLEWVSVIYSGGSTYYADSVKGRFTISRDNSKNTLYLQMNSLRAEDTAVYYCARATQDILTGYLYSGMDVWGKGTLVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKR

SEQ ID NO: 1178 - protein, 248 aa, Homo sapiens
EVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREHYDILTGYSLLGMDVWGRGTLVTVSSGGGGSGGGGSGGGGSSELTQDPAVSVALGQTVRITCQGDSLRGYYTNWFQQKPGQAPLLVVYAKNKRPSGIPDRFSGSSSGNTASLTITGAQAEDEADYYCHSRDSSGNHVVFGGGTKLTVLG

SEQ ID NO: 1179 - protein, 250 aa, Homo sapiens
EVQLVETGGGLVKPGGSLRLSCAASGFTFSSYEMNWVRQAPGKGLEWVSYISSSGSTIYYADSVKGRFTISRDNAKNSLYLQMNSLRAEDTAVYYCTTDGYYDILTGYSVYYGMDVWGRGTLVTVSSGGGGSGGGGSGGGGSSELTQDPAVSVALGQTVRITCQGDSLRSYYTNWFQQKPGQAPLLVVYAKNKRPSGIPDRFSGSSSGNTASLTITGAQAEDEADYYCHSRDSSGNHVLFGGGTKLTVLG

SEQ ID NO: 1180 - protein, 253 aa, Homo sapiens
GVQLVESGGGLIQPGGSLRLSCAASGFSVSSNHMNWVRQAPGKGLEWVSVTYSGGNTNYADSVRGRFTISRDNSKNTLYLQMNSLRAEDTAVYYCAREGSYDILTGYYVGVGRMDVWGRGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1181 - protein, 248 aa, Homo sapiens
QVQLQQSGAEVKKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGQGTMVTVSSGGGGSGGGGSGGGGSSELTQDPAVSVALGQTVRITCQGDSLRSYYTNWFQQKPGQAPLLVVYAKNKRPSGIPDRFSGSSSGNTASLTITGAQAEDEADYYCNSRDSSGNHVVFGGGTKLTVLG

SEQ ID NO: 1182 - protein, 248 aa, Homo sapiens
EVQLVQSGAEVKKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGQGTMVTVSSGGGGSGGGGSGGGGSSELTQDPAVSVALGQTVRITCQGDSLRSYYTNWFQQKPGQAPLLVVYAKNKRPSGIPDRFSGSSSGNTASLTITGAQAEDEADYYCNSRDSSGNHVVFGGGTKLTVLG

SEQ ID NO: 1183 - protein, 256 aa, Homo sapiens
EVQLVESGGGLVQSGGSLRLSCAGSGFTFSSYAMSWVRQAPGKGLEWVSAISGSGGSTYYADSVKGRFTISRDNSKNTLYLQMNSLRAEDTAVYYCAKDDRRGYYDILTGYYRFGSFDIWGRGTLVTVSSGGGGSGGGGSGGGGSQSVLTQPPSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLG

SEQ ID NO: 1184 - protein, 244 aa, Homo sapiens
GVQLVQSGAEAKKPGSSVKVSCKASGGTFNRYAISWVRQAPGQGLEWMGRIIPMLGTANYAQNFQGRVTITADKLTRTVFMELISLRSEDSAMYYCARDIDIGGDDSWGQGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1185 - protein, 251 aa, Homo sapiens
GVQLVQSGAEVKKPGSSVKVSCQTSGTTFRHSAITWVRQAPGQGFEWLGHIIPVFETAHLSDKFQGRVTITADELTTTVYMELSSLRFEDTAVYYCARVSGYNSGYFESYDMDVWGRGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1186 - protein, 254 aa, Homo sapiens
QVQLQQWGGGVVQPGRSLRLSCEASGFTFSSYEMHWVRQAPGKGLEWVAVISYDERIKNYGDSVKGRFTGSRDNSKNTLYLEMNSLRPEDTAVYYCATEVRNYDLLTRSYLAGPLDNWGRGTMVTVSSGGGGSGGGGSGGGGSQSVLTQPASASGTPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1187 - protein, 251 aa, Homo sapiens
QVQLVQSGAEVKKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGQGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1188 - protein, 249 aa, Homo sapiens
QVQLQQSGPGLVKPSQTLSLTCAISGDSVTSNSVAWNWLRQSPSRGLEWLGRTYYRSQWYANYAESVRSRITINPDTSKNQFSLQLNSVTPEDTAVYYCARSGEPCITLACNLGGWGQGTLVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKR

SEQ ID NO: 1189 - protein, 256 aa, Homo sapiens
QVQLVQSGGGLVQPGGSLRLSCAASGFTFSSYAMHWVRQAPGKGLEWLATISYDGSNKDYADSVKGRFTISRDNSKNTLYLQMNSLRAEDTAVYYCARDASEYYDILTGYYLATGRNWFDPWGRGTTVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSSTHRGVFGGGTKLTVLG

SEQ ID NO: 1190 - protein, 255 aa, Homo sapiens
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARDPSPYYDILTGYFLPYYMDVWGKGTLVTVSSGGGGSGGGGSGGGGSQPVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1191 - protein, 250 aa, Homo sapiens
QVQRVESGGGLVKPGGSLRLSCAASGFTFSNAWMSWVRQAPGKGLEWVGRIKSKTDGGTTDYAAPVKGRFTISRDDSKNMLYLQMNSLKTEDTAVYYCTTEIDDILTGYYMDVWGRGTTVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1192 - protein, 246 aa, Homo sapiens
QVQLQQSGAEVKKPGASVKVSCKASGYTFTSYGISWVRQAPGQGLEWMGWISAYGNTNYAQKFQGRVTMTTDTSTSTAYMELRSLRSDDTAVYYCARMNYDILTGLVNWFDPWGQGTMVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRGSSGNHVVFGGGTKLTVLG

SEQ ID NO: 1193 - protein, 247 aa, Homo sapiens
QVTLKESGGGLVKPGRSLRLSCTASGFTFGDYAMSWFRQAPGKGLEWVGFIRSKAYGGTTEYAASVKGRFTISRDDSKNTLYLQMTSLRAEDSAVYYCVRRDILTGFYDSWGRGTTVTVSSGGGGSGGGGSGGGGSQSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLG

SEQ ID NO: 1194 - protein, 251 aa, Homo sapiens
GVQLVQSGAEVKRPGSSVKVSCKASGGTSRSFAISWVRQAPGQGLEWMGWTNPNSGATNYAQKFQGRVTMTRDTSISTAYMELSRLTSDDTAIYYCARATYDPLTGYSFDGFDIWGQGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1195 - protein, 254 aa, Homo sapiens
GVQLVESGGNLVQPGGSLRLSCAASGFNLGNYAMSWVRQAPGEGLEWVSGFSGIGSTTYYADSVKGRFTISRDNSKNTLYLQMNSLRGEDTAVYYCAREGSYDILTGYYVGVGRMDVWGRGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1196 - protein, 254 aa, Homo sapiens
EVQLVQSGGVVVQPGGSLRLSCEASGFTFSSYGMHWVRQAPGKGLEWVAVISYDERIKNYGDSVKGRFTGSRDNSKNTLYLEMNSLRPEDTAVYYCATEVRNYDLLTRSYLAGPLDNWGKGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1197 - protein, 254 aa, Homo sapiens
QVQLVQSGGGVVQPGRSLRLSCAASGFTFSSYGMHWVRQAPGKGLEWVAVISYDERIKNYGDSVKGRFTGSRDNSKNTLYLEMNSLRPEDTAVYYCATEVRNYDLLTRSYLAGPLDNWGQGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1198 - protein, 248 aa, Homo sapiens
QVQLVQSGGGVVQPGRSLRLSCAASGFTFSSYGMHWVRQAPGKGLEWVANISPHGNDNRYVDSVKGRFTISRDNSKNTLYLQMNSLRAEDTAVYYCARGYYDILTGYQSDAFDIWGRGTMVTVSSGGGGSGGGGSGGGGSSELTQDPAVSVALGQAVRITCQGDSLRSYYTNWFQQKPGQAPLLVVYAKNKRPSGIPDRFSGSSSGNTASLTITGAQAEDEADYYCNSRDSSGNHVVFGGGTELTVLG

SEQ ID NO: 1199 - protein, 253 aa, Homo sapiens
QVQLVQSGAEVKKPGSSVKVSCQASGGTFSRYATTWVRQAPGQGLEWMGGIIPLFRTTKFAQRLQGRVSITADELTNTAFMELSSLTSEDTGVYYCATTERFGAKDVTARWGMDVWGQGTLVTVSSGGGGSGGGGSGGGGSAQAVLTQPSSASGTPGQRVTISCSGSSSNIGSNVINWYQQLPRTAPKLLIHTNDQRPSGVPDRFSGSKSGTSGTLAISGLQSEDEADYYCAAWDDRLKAWVFGGGTKLTVLG

SEQ ID NO: 1200 - protein, 253 aa, Homo sapiens
EVQLVQSGGGVVQPGRSLRLSCAASGFTFSSYAMHWVRQAPGKGLEWVAVISYDGSNEYYAGSVKGRFTISRDNSRNTLYLQMNSLRAEDTAVYYCARENYDILTGYYNFFDYWGRGTMVTVSSGGGGSGGGGSGGGGSAQSVLTQPPSVSAAPGQKVTISCSGSNSNIGHNYISWYQHIPGTAPKLLIFDTNKRPSGIPDRFSGSKSGTSATLAITELQTADEADYYCATWDTTLSAENVLFGGGTKVTVLG

SEQ ID NO: 1201 - protein, 252 aa, Homo sapiens
QLQLQESGGGVVQPGRSLRLSCAASGFTFSSYGMHWVRQAPGKGLEWVAVISYDGSNKYYADSVKGRFTISRDNSKNTLYLQMNSLRAEDTAVYYCAKRQYDILTGYYGGFDYWGKGTLVTVSSGGGGSGGGGSGGGGSAQAVLTQPSSVSGAPGQRVTISCTGSGSNIGAGYDVHWYQHLPGTAPKLLIFGNNNRPSGVPDRFSGSKSGTSASLAITGLQGEDEADYYCQSFDTSLGVRVFGGGTQLTVLS

SEQ ID NO: 1202 - protein, 249 aa, Homo sapiens
QVQLVQSGAEVKKPGSSVKVSCRASGGSFNHAISWVRQAPGRGLEWMGGILPMYGTANYAQKFQGRVTITADKLTNTVYMDLSRLRYEDTAVYYCARELGLSIVGATTGALDMWGRGTLVTVSSGGGGSGGGGSGGGGSAQSVLTQPPSASGTPGQRVTISCSGSYSNIGTNDVFWYQQLPGTAPQLLIYRNNQRPSGVPDRFSGSKSGTSASLAISGLRSEDEADYYCAAWNDRQIVFGGGTKLTVLG

SEQ ID NO: 1203 - protein, 250 aa, Homo sapiens
EVQLVQSGPEVKKPGSSVKVSCKASGGTFSSYAFNWVRRAPGQGLEWLGSIVPVFNTKTFARKFQGRVTLTADELTRTAYLELSNLRSDDTAVYYCASRYGDPFYYYYYMNVWGRGTLVTVSSGGGGSGGGGSGGGGSAQSVLTQPPSASGTPGQRVTISCSGSSSNIRSKTVNWYQQLPGTAPKLLIYSNNQRPSGVPDRFSGSKSGTSASLAISGLQSEDEADYYCAAWDDSLNGPVFGGGTKVTVLG

SEQ ID NO: 1204 - protein, 249 aa, Homo sapiens
QVQLVQSGAEVKKPGSSVKVSCKASGGTFSSYAFNWVRRAPGQGLEWLGSIVPVFNTKTFARKFQGRVTLTADELTRTAYLELSNLRSDDTAVYYCASRYGDPFYYYYYMNVWGKGTMVTVSSGGGGSGGGGSGGGGSALSSELTQDPAVSVALGQTVRITCQGDSLRSNYASWYQQKPGQAPVLVIYGKNKRPSGIPDRFSGSSSGNTASLTITGAQAEDEADYHCHSRDISGDHQIFGGGTKLTVLG

SEQ ID NO: 1205 - protein, 249 aa, Homo sapiens
QVQLVQSGAEVKKPGSSVKVSCKASGGTFSSYAFNWVRRAPGQGLEWLGSIVPVFNTKTFARKFQGRVTLTADELTRTAYLELSNLRSDDTAVYYCASRYGDPFYYYYYMNVWGKGTMVTVSSGGGGSGGGGSGGGGSALSSELTQDPAVSVPLGQTVRITCQGDSLRSYYASWYQQKPGQAPRLVIYGKDNRPSGIPDRFSGSSSGNTASLTITGTQAEDEADYYCNSRDSGGNHVVFGGGTKLTVLG

SEQ ID NO: 1206 - protein, 247 aa, Homo sapiens
QVQLVQSGAEVKKPGSSVKVSCRASGGSFNHAISWVRQAPGRGLEWMGGILPMYGTANYAQKFQGRVTITADKLTNTVYMDLSRLRYEDTAVYYCARELGLSIVGATTGALDMWGQGTLVTVSSGGGGSGGGGSGGGGSAQSVLTQPPSVSVSPGQTASISCSGDKLGDKYASWYQQKPGQSPILIIFQNTRRPSGIPERFSGSNSGNTATLTITETQTMDEADYFCQAWDSSTGVFGGGTKVTVLG

SEQ ID NO: 1207 - protein, 251 aa, Homo sapiens
QVQLVQSGAEVRKPGSSVRVFCEASGGKFSNYSLNWLRQAPGQGPEWMGRIIPVLDIVDYAPKFQGRLTITADKLTGTIFMELNSLRAEDTAIYYCARELGHREGGYWYSPYNVWGQGTMVTVSSGGGGSGGGGSGGGGSALSSELTQDPAVSVALGQTVRITCRGDPLRNSYASWYQQRPGQAPLLVHFGKDNRPSRIPERFSGSNSGDTASLIITGAQAEDEADYYCSSRDSSGNHYVFGAGTKVTVLG

SEQ ID NO: 1208 - protein, 252 aa, Homo sapiens
EVQLVQSGAEVKKPGSSVKVSCKASGGTFSSYAFNWVRRAPGQGLEWLGSIVPVFNTKTFARKFQGRVTLTADELTRTAYLELSNLRSDDTAVYYCASRYGDPFYYYYYMNVWGRGTLVTVSSGGGGSGGGGSGGGGSAQAVLTQPSSVSGAPGQRVTISCTGGSSNIGAGYDVHWYQQIPGTAPKLLIYGNSNRPSGVPDRFSGSKSGTSASLAITGLQAEDEADYYCQSYDSSLNGPVVFGGGTKLTVLG

SEQ ID NO: 1209 - protein, 256 aa, Homo sapiens
EVQLVETGGGLVKPGGSLRLSCAASGFTFSGYSMNWVRLAPGKGLEWVASIRSRSGGTYIYYADSVKGRFTISRDNAKNSLYLQMNSLRAEDTAVYYCARDPGNYDILTGYYYYYGMDVWGQGTMVTVSSGGGGSGGGGSGGGGSAQSALTQPASVSGSPGQSITISCTGTSSDVGAYPFVSWYQQHPGKVPKLIIHDVSHRPSGVSNRFSGSKSGNTASLTISGLQAEDEADYYCSSFTGSIYVFGTGTKLTVLG

SEQ ID NO: 1210 - protein, 244 aa, Homo sapiens
QVQLVQSGAEVKKPGASVKVSCQASGYTFREYGIIWARQAPGQGLEWMGWISGQNGKTNLAQRFQGRVTITTDTLTSTAFMELTNLRVDDTAMYYCAASGPGWFDPWGKGTLVTVSSGGGGSGGGGSGGGGSAQSVLTQPPSASGTPGQRVTISCSGSSSNIGSNTVNWYQQLPGTAPKLLIYSNNQRPSGVPDRFSGSKSGTSASLAISGLQSEDGADYYCAAWDDSLNGYVFGTGTKLTVLG

SEQ ID NO: 1211 - protein, 251 aa, Homo sapiens
QMQLVQSGAEVKKPGSSVKVSCRASGGSFNHAISWVRQAPGRGLEWMGGILPMYGTANYAQKFQGRVTITADKLTNTVYMDLSRLRYEDTAVYYCARELGLSIVGATTGALDMWGQGTLVTVSSGGGGSGGGGSGGGGSAQSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGWVFGGGTKLTVLG

SEQ ID NO: 1212 - protein, 250 aa, Homo sapiens
EVQLVQSGAEVKEPGSSVKVSCRASGGSFNHAISWVRQAPGRGLEWMGGILPMYGTANYAQKFQGRVTITADKLTNTVYMDLSRLRYEDTAVYYCARELGLSIVGATTGALDMWGQGTMVTVSSGGGGSGGGGSGGGGSAQSVLTQPPSASGTPGQRVTISCSGSSSNIGSNYVYWYQQLPGTAPKVLIYSNNQRPSGVPDRFSGFKSGTSASLVISGLRSEDEADYYCAAWDDRLSGLFGGGTKLTVLG

SEQ ID NO: 1213 - protein, 251 aa, Homo sapiens
QMQLVQSGAEVKKPGSSVKVSCKASGGTFSSYAFNWVRRAPGQGLEWLGSIVPVFNTKTFARKFQGRVTLTADELTRTAYLELSNLRSDDTAVYYCASRYGDPFYYYYYMNVWGQGTLVTVSSGGGGSGGGGSGGGGSAQAVLTQPSSVSGAPGQRVTISCTGSSSNIGAGYDVHWYQQLPGTAPKLLIYGNSNRPSGVPDRFSGSKSGTSASLAITGLQAEDEADYYCQSYDSSLSGWVFGGGTKLTVLG

SEQ ID NO: 1214 - protein, 244 aa, Homo sapiens
QVQLVQSGAEVKKPGASVKVSCQASGYTFREYGIIWARQAPGQGLEWMGWIIGHNGMTNLAQRFQGRVTITTDTLTSTAFMELTNLRVDDTAMYYCAASGPGWFDPWGKGTLVTVSSGGGGSGGGGSGGGGSAQSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGYVFGAGTKLTVLG

SEQ ID NO: 1215 - protein, 249 aa, Homo sapiens
QVQLVQSGAEVKKPGSSVKVSCKASGGTFSSYAFNWVRRAPGQGLEWLGSIVPVFNTKTFARKFQGRVTLTADELTRTAYLELSNLRSDDTAVYYCASRYGDPFYYYYYMNVWGQGTLVTVSSGGGGSGGGGSGGGGSALSSELTQDPAVSVALGQTVRITCRGDSLSRNFANWYQQKPGQAPLLVIYGNNNRPPGVSDRLSGSKTGNTASLTITGAQAEDEADYYCNSRKSSANHWLFGGGTKLTVLG

SEQ ID NO: 1216 - protein, 251 aa, Homo sapiens
QVQLVQSGAEVKKPGSSVKVSCRASGGSFNHAISWVRQAPGRGLEWMGGILPMYGTANYAQKFQGRVTITADKLTNTVYMDLSRLRYEDTAVYYCARELGLSIVGATTGALDMWGRGTLVTVSSGGGGSGGGGSGGGGSAQAVLTQPSSASGTPGQRVTISCTGSSSNVGGNVVNWYQQVPGTAPKLLIYNTNQRPAGVPDRFSGSKSGAAASLAIRGLQSQDEADYYCEAWDDSLYGHVFGGGTKLTVLG

SEQ ID NO: 1217 - protein, 251 aa, Homo sapiens
QVQLVQSGAEVKKPGSSVKVSCKASGGTFSSYAFNWVRRAPGQGLEWLGSIVPVFNTKTFARKFQGRVTLTADELTRTAYLELSNLRSDDTAVYYCASRYGDPFYYYYYMNVWGQGTLVTVSSGGGGSGGGGSGGGGSAQAVLTQPSSVSGAPGQRVTISCTGTSSNIGADYAVHWYQQVPGVAPRLLIYGNTNRPSGVPDRFSASKSGTSASLAITGLQPEDEADYYCQTYDSRLSGSVFGGGTKLTVLG

SEQ ID NO: 1218 - protein, 252 aa, Homo sapiens
QVQLVQSGAEVKKPGSSVKVSCRASGGSFNHAISWVRQAPGRGLEWMGGILPMYGTANYAQKFQGRVTITADKLTNTVYMDLSRLRYEDTAVYYCARELGLSIVGATTGALDMWGKGTLVTVSSGGGGSGGGGSGGGGSALSYELTHAPSASGTPGQRVTICCSGSSSNIGNNYIYWYQQLPGTAPKLLIGRYDQRPSGVPDRFSGSKSGTSASLAISGLRSEDEADYYCATWDDSLSGWVFGGGTQLTVLS

SEQ ID NO: 1219 - protein, 251 aa, Homo sapiens
QVQLVQSGAEVKKPGSSVKVSCRASGGSFNHAISWVRQAPGRGLEWMGGILPMYGTANYAQKFQGRVTITADKLTNTVYMDLSRLRYEDTAVYYCARELGLSIVGATTGALDMWGQGTLVTVSSGGGGSGGGGSGGGGSALETTLTQSPGTLSLSPGERATLSCRASQSVSSSYLAWYQQKPGQAPRLLIYGASSRATGIPDRFSGSGSGTDFTLTISRLEPEDFAVYYCQQYGSSPLLTFGGGTRLEIKR

SEQ ID NO: 1220 - protein, 251 aa, Homo sapiens
QVQLVQSGAEVKKPGSSVKVSCRASGGSFNHAISWVRQAPGRGLEWMGGILPMYGTANYAQKFQGRVTITADKLTNTVYMDLSRLRYEDTAVYYCARELGLSIVGATTGALDMWGRGTLVTVSSGGGGSGGGGSGGGGSAQSVLTQPPSASGTPGQRVTISCSGRDSNIGSNSVYWYQQVPGTAPKLLIYRNTLRPSGVPDRLSGSSSGTSASLAISGLQSDDEADYYCASWDDSVGSWVFGGGTKLTVLG

SEQ ID NO: 1221 - protein, 252 aa, Homo sapiens
QVQLVQSGAEVKKPGSSVKVSCRASGGSFNHAISWVRQAPGRGLEWMGGILPMYGTANYAQKFQGRVTITADKLTNTVYMDLSRLRYEDTAVYYCARELGLSIVGATTGALDMWGRGTLVTVSSGGGGSGGGGSGGGGSAQSVLTQPPSVSGAPGQRVTISCTGSSSNIGAGSDVHWYQQLPGTAPKLVIYVNNNRPSGVPGRFSGSKSGTSASLAITGLQAEDEADYYCQSFDSSLSGFVFGTGTKVTVLG

SEQ ID NO: 1222 - protein, 250 aa, Homo sapiens
QVQLVQSGAEVKKPGSSVKVSCKASGGTFSSYAFNWVRRAPGQGLEWLGSIVPVFNTKTFARKFQGRVTLTADELTRTAYLELSNLRSDDTAVYYCASRYGDPFYYYYYMNVWGQGTLVTVSSGGGGSGGGGSGGGGSAQSVLTQPPSASGTPGQRVTITCSGSRSNIGKNYVSWYQQFPGTAPKLLMYRNDQRPSGVPDRISGSKSGTSASLAISGLRSEDDTDYYCATWDDSLNGLVFGGGTKVTVLG

SEQ ID NO: 1223 - protein, 252 aa, Homo sapiens
QVQLQESGPGVVKPSETLSLTCTVSGGFISSRTSYWGWIRQPPGKGLEWIGNIYYTGKTYYSPSLKSRVTISADTSKNQLSLKLSSVTAADTAVYYCARAGYDLLTGYPFYFDSWGKGTMVTVSSGGGGSGGGGSGGGGSAQSVLTQPPSASGTPGQRVTISCSGSSSNIGSNTVNWYQQLPGTAPKLLMYLNNQRPSGVPDRFSGSKSGTSASLAISGLQSEDEADYYCLTWDDSLNGPVFGGGTKVTVLG

SEQ ID NO: 1224 - protein, 251 aa, Homo sapiens
QVQLVQSGAEVKKPGSSVKVSCRASGGSFNHAISWVRQAPGRGLEWMGGILPMYGTANYAQKFQGRVTITADKLTNTVYMDLSRLRYEDTAVYYCARELGLSIVGATTGALDMWGKGTMVTVSSGGGGSGGGGSGGGGSAQSVLTQPPSASGTPGQRVTISCSGSRSNIGSNPVYWYQQFPGMAPKLLLYANNQRPSELPDRFSGTKSGTSASLDISGLQSEDEADYYCAVWDDSLDGAVFGGGTKLTVLG

SEQ ID NO: 1225 - protein, 251 aa, Homo sapiens
QVQLVQSGAEVKKPGSSVKVSCKASGGTFSSYAFNWVRRAPGQGLEWLGSIVPVFNTKTFARKFQGRVTLTADELTRTAYLELSNLRSDDTAVYYCASRYGDPFYYYYYMNVWGQGTLVTVSSGGGGSGGGGSGGGGSAQSVLTQPPSLSGAPGQRVTISCTGSSSNIGAGYDVHWYQQLPGTTPKLLIYGNNNRPSGVPDRFSGSKSGTSASLAITGLQAEDEADYYCQSFDSSLSGKVFGGGTKVTVLG

SEQ ID NO: 1226 - protein, 254 aa, Homo sapiens
QVQLVQSGAEVKKPGSSVKVSCRASGGSFNHAISWVRQAPGRGLEWMGGILPMYGTANYAQKFQGRVTITADKLTNTVYMDLSRLRYEDTAVYYCARELGLSIVGATTGALDMWGRGTLVTVSSGGGGSGGGGSGGGGSAQAVLTQPSSVSGAPGQSVTISCTGGGSNLGAGFDVHWYQHLPGAAPKLIIYDNRNRPSGVPARFSGSKSGTSASLAITGLQPEDEGDYYCQSYDGTSRSGSWVFGGGTKLTVLG

SEQ ID NO: 1227 - protein, 253 aa, Homo sapiens
QVQLVQSGAEVKKPGSSVKVSCRASGGPFNHAISWVRQAPGRGLEWMGGILPMYGTANYAQKFQGRVTITADKLTNTVYMDLSRLRYEDTAVYYCARELGLSIVGATTGALDMWGRGTTVTVSSGGGGSGGGGSGGGGSALSYVLTQPPSASGTPGQRVTISCSGSSSNIGSNTVNWYQQLPGTAPKLLIYTDNQRPSGVPDRFSGSRSGTSASLAISGLQSQDEADYYCATWDDSLNGPVVFGGGTKLTVLG

SEQ ID NO: 1228 - protein, 250 aa, Homo sapiens
QVQLVQSGAEVKKPGSSVKVSCKASGGTFSSYAFNWVRRAPGQGLEWLGSIVPVFNTKTFARKFQGRVTLTADELTRTAYLELSNLRSDDTAVYYCASRYGDPFYYYYYMNVWGRGTLVTVSSGGGGSGGGGSGGGGSAQPVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNVYVFGTGTKVTVLG

SEQ ID NO: 1229 - protein, 251 aa, Homo sapiens
EVQLVQSGAEVKKPGSPVRVSCKASGGTFTRYAISWVRQAPGQGLEWMGRIIPILGIANYAQKFQGRVTITADKLTSTVYMELSSLRSEDTAVYYCARDNYDILTGYSRRFDPWGRGTLVTVSSGGGGSGGGGSGGGGSAQSVLTQPPSASGTPGQRVTISCSGSSSNIGSNTVSWYQQLPGTAPKLLIYTNDQRPSGVPDRFSGSKSGTSASLAISGLQSEDEADYYCATWDDGLNGWVFGGGTKLTVLG

SEQ ID NO: 1230 - protein, 256 aa, Homo sapiens
EVQLVQSGAEVKKPGSSVKVSCRASGGSFNHAISWVRQAPGRGLEWMGGILPMYGTANYAQKFQGRVTITADKLTNTVYMDLSRLRYEDTAVYYCARELGLSIVGATTGALDMWGQGTMVTVSSGGGGSGGGGSGGGGSAQAVLTQPSSLSASPGASASLTCTLRSGINVGTNTIYWYQQKPGSPPQYLLKYKSDSDKHQGSGVPSRFSGSKDASANAGVLLISGLQSEDEADYYCMIWHSSASVFGTGTKLTVLG

SEQ ID NO: 1231 - protein, 251 aa, Homo sapiens
QVQLVQSGAEVKKPGSSVKVSCKASGGTFSSYAFNWVRRAPGQGLEWLGSIVPVFNTKTFARKFQGRVTLTADELTRTAYLELSNLRSDDTAVYYCASRYGDPFYYYYYMNVWGQGTLVTVSSGGGGSGGGGSGGGGSAQAVLTQPSSVSGAPGQRVTISCTGSSSSIGAGYDVNWYQHLPGTAPKLLIYGNNNRPSGVPDRFSGSKSGTSASLAITGLQAEDEGDYYCQSYDRGLSGYVFGTGTKVTVLG

SEQ ID NO: 1232 - protein, 251 aa, Homo sapiens
QVQLVQSGAEVKKPGSSVKVSCRASGGPFNHAISWVRQAPGRGLEWMGGILPMYGTANYAQKFQGRVTITADKLTNTVYMDLSRLRYEDTAVYYCARELGLSIVGATTGALDMWGRGTLVTVSSGGGGSGGGGSGGGGSALSSELTQDPAVSVALGQTVKITCQGDRLRRFYASWYQQKPGQAPLLLIYGKNSRPSGIPDRFSGSTSGATASLTITGAQAEDEADYYCNSRDSSGSLHSVFGTGTKVTVLG

SEQ ID NO: 1233 - protein, 255 aa, Homo sapiens
EVQLVESGGGVVQPGGSLRLSCVGSGFTFSSYGMHWVRQAPGKGLEWMAVISSDGTKRYYADSVQGRLTISRDNFVKTLSLEMHSLRAEDTAVYYCAKDRGGNYDILTGYYFHHGVDVWGRGTLVTVSSGGGGSGGGGSGGGGSAQSVLTQPPSASGSPGHSVTISCTGTSSDVGSYNYVSWYQQHPGKAPKLMIYDVSKRPSGVPDRFSGSKSGNTASLTVSGLQAEDEADYYCGSYVGPNMVFGGGTKLTVLG

SEQ ID NO: 1234 - protein, 258 aa, Homo sapiens
QVQLQESGPGLVKPSQTLSLTCDISGDSVSSNSAAWNWIRQAPSRGLEWLGRTYYRSKWYTDYAESVKSRLAINPDTSKNQFSLQLSSVTPEDTAVYYCARATKSYDILTRMYYYHMDVWGRGTLVTVSSGGGGSGGGGSGGGGSALNFMLTQPHSVSESPGKTVTISCTRSSGSIDSNYVQWYRQRPGSSPTTVIYEDNQRPSGVPDRFSGSIDRSSNSASLTISGLTTEDEADYYCQSYDARNQVFGGGTQLTVLS

SEQ ID NO: 1235 - protein, 253 aa, Homo sapiens
EVQLVQSGAEVKKPGSPVRVSCKASGGTFTRYAISWVRQAPGQGLEWMGRIIPILGIANYAQKFQGRVTITADKLTSTVYMELSSLRSEDTAVYYCARDNYDILTGYSRRFDPWGRGTMVTVSSGGGGSGGGGSGGGGSAQAVLTQPSSVSGAPGQRVTISCTGSSSNIGAGYDVHWYQQLPGTAPKLLIYGNSNRPSGVPDRFSGSKSGTSASLAITGLQAEDEADYYCQSYDSSLSGSYVFGTGTKLTVLG

SEQ ID NO: 1236 - protein, 252 aa, Homo sapiens
EVQLVQSGAEVKKPGSSVKVSCRASGGSFNHAISWVRQAPGRGLEWMGGILPMYGTANYAQKFQGRVTITADKLTNTVYMDLSRLRYEDTAVYYCARELGLSIVGATTGALDMWGRGTMVTVSSGGGGSGGGGSGGGGSALSYVLTQPPSASGTPGQRVTISCSGSSSNIGDNSVSWYQQVPGLAPKLLIYRNNQRPSGVPDRFSGSKSGTSASLAISGLRSEDEVDYYCATWDDSLSGPVFGGGTKLTVLG

SEQ ID NO: 1237 - protein, 248 aa, Homo sapiens
QVQLVQSGAEVRKPGSSVKVSCKASGGSFSSHVFSWVRQAPGQGLEWVGGITPKFATPNYAQKFQHRVTITADELTRTVFMDLSGLRSEDTAVYYCARGYDSSAFRAFDIWGRGTLVTVSSGGGGSGGGGSGGGGSAQAVLTQPSSVSGAPGQRVTISCTGSSSKIGANYDVQWYQQLPGTAPKLLIYGNNNRPSGVPSRFSGSKSGTSASLVITGLQSEDEADYYCQSYDTGLGEVFGGGTKVTVLG

SEQ ID NO: 1238 - protein, 251 aa, Homo sapiens
QVQLVQSGAEVKKPGASVKVSCKASGYSFSSHGISWVRQAPGQGLEWVGWSSAHDDNTKYAQKFQGRVTMTTDASTSTAYMELRSLRSDDTAVYYCARPYYDPLTAYTFQYFGNWGQGTLVTVSSGGGGSGGGGSGGGGSALETTLTQSPATLSVSPGERVTLSCRASQSVSSNLAWFQQKPGQAPRLLIYGASTRFTGIPARFSGSGSGTDFSLTISSLQSEDFAVYYCQQYNNWPPITFGQGTRLEIKR

SEQ ID NO: 1239 - protein, 258 aa, Homo sapiens
EVQLVQSGAEVKKPGSSVKVSCKASGGALSSDAISWVRQAPGQGLEWMGGIIPTFRKTKYAQKFQGRVTITADELTRTVFMELSSLKSEDTAVYYCARGREDTDKVKPWDRYYHYYYMDVWGKGTMVTVSSGGGGSGGGGSGGGGSAQSVLTQPPSVSAAPGQKVTISCSGSSSNVENNYVSWYQHLPGTAPKLLMYEDEKRPSEIPDRFSGSKSGTSATLAITGLQTGDEADYYCGTWDNSLSAGVFGGGTKLTVLG

SEQ ID NO: 1240 - protein, 257 aa, Homo sapiens
EVQLVQSGAEVKKPGSSVKVSCKASGGALSSDAISWVRQAPGQGLEWMGGIIPTFRKTKYAQKFQGRVTITADELTRTVFMELSSLKSEDTAVYYCARGREDTDKVKPWDRYYHYYMDVWGQGTLVTVSSGGGGSGGGGSGGGGSAQSVLTQPPSASGTPGQRVTIACSGSSSNIGINYVYWYQQLPGMAPKLLISRNNQRPSGVPDRFSGSKSGTTASLAISGLRSEDEADYYCAAWDDNLSGVVFGGGTKVTVLG

SEQ ID NO: 1241 - protein, 246 aa, Homo sapiens
EVQLVQSGGGLIKPGGSLTLSCAASADILNTAWVNWFRQAPGKGLEWVGRIKPKAQGGTTDYATPVKGRFTLSRDELTNTLFLHMSSLRTDDAAVYYCSAGLGHTDSDSWGQGTLVTVSSGGGGSGGGGSGGGGSAQSALTQPASVSGSPGQSITISCTGTSNDIDSHNYVSWYQQYPGTAPKLLIYDVSSRPSGVSNRFSGSKSGNTASLTISGLQAEDEAEYYCSSYSNNDKMFGGGTKVTVLG

SEQ ID NO: 1242 - protein, 253 aa, Homo sapiens
QVQLVQSGAEVKKPGSSVKVSCQASGGTFRTHAFHWVRQAPGEGLEWMGGIIPKFGTPNYAQKFQDRVTIIADELTSTVYMELSSLRSEDTAVYFCAIAKGYYYDSSGASDVFDVWGRGTLVTVSSGGGGSGGGGSGGGGSAQAVLTQPSSVSAAPGQQVSISCSGTSSNIGKNYVYWYQHLPGAAPKFLIYDNNKRPSGIPPRFSASKSGTSATLGITGLQPGDEGDYYCGTWDSSLATVIFGGGTKLTVLG

SEQ ID NO: 1243 - protein, 258 aa, Homo sapiens
QVQLVQSGAEVKKPGSSVKVSCKASGGALSSDAISWVRQAPGQGLEWMGGIIPTFRKTKYAQKFQGRVTITADELTRTVFMELSSLKSEDTAVYYCARGREDTDKVKPWDRYYHYYYMDVWGRGTLVTVSSGGGGSGGGGSGGGGSAQSVLTQPPSASGTPGQRVLVSCSGSTSNIGTNTVDWYQQLPGTAPKLLIYRDSQRPSGVPDRFSGSRSGTSASLAISGLQSEDEAVYYCATWDDSRGGWVFGGGTKLTVLG

SEQ ID NO: 1244 - protein, 260 aa, Homo sapiens
QVQLVQSGAEVSKPGSSVKVSCRASGGSLIDYSINWVRQAPGQGLEWVGGTVPLANTANYAQKFRGRVTITADELTATVFLELTSLRSDDTALYYCAKSSPPKWYDALTGHSSYHSAMDVWGRGTMVTVSSGGGGSGGGGSGGGGSALSYVLTQPPSASGTPGQRVTISCSGRSSNIGSNTVNWYQHLPGTAPKLLIHSNNQRPSGVPDRFSGSKSGTSASLAISGLQSEDEADYYCSAWDDSLNGHVVFGGGTKLTVLG

SEQ ID NO: 1245 - protein, 258 aa, Homo sapiens
QVQLVQSGAEVRKPGSSVRVSCRASGGSFIDQSITWVRQAPGQGLEWVGGTIPLANTANYAQKFRGRVTITADELTTTVFLELTSLRSDDTAVYFCAKSNPPKWYDALTGHSSYHSAMDVWGRGTLVTVSSGGGGSGGGGSGGGGSAQSVLTQPPSVSKALRQSATLTCTGNSNNVGNEGAVWLQQHQGQPPKLLIDRKNNRPSGISERFSASRSGNTASLTISGLQSEDEADYYCAAWDSGLSVWLFGGGTKVTVLG

SEQ ID NO: 1246 - protein, 248 aa, Homo sapiens
QVQLVQSGAEVRKPGSSVKVSCKASGGSFSSHVFSWVRQAPGQGLEWVGGITPKFATPNYAQKFQHRVTITADELTRTVFMDLSGLRSEDTAVYYCARGYDSSAFRAFDIWGRGTLVTVSSGGGGSGGGGSGGGGSAQSVLTQPPSVSAAPGQKVTISCSGSSSNIGNNNVSWYQQLPGTAPKLLIYDNNKRPSGIPDRFSGSKSGTSATLGITGLQTGDEADYHCGTWDSSLVAVVFGGGTKLTVLG

SEQ ID NO: 1247 - protein, 259 aa, Homo sapiens
QVQLVQSGAEVKKPGSSVKVSCKASGGALSSDAISWVRQAPGQGLEWMGGIIPTFRKTKYAQKFQGRVTITADELTRTVFMELSSLKSEDTAVYYCARGREDTDKVKPWDRYYHYYYMDVWGQGTLVTVSSGGGGSGGGGSGGGGSAQSVLTQPPSASGSPGQSVTISCTGTDSDIGGFNYVSWYQHHPGKAPKLILYEVTKRPSGVPDRFSGSKAGNTASLTVSGLQAEDEADYYCSSYEGSNNAYVFGTGTKVTVLG

SEQ ID NO: 1248 - protein, 248 aa, Homo sapiens
QVQLVQSGAEVRKPGSSVKVSCKASGGSFSSHVFSWVRQAPGQGLEWVGGITPKFATPNYAQKFQHRVTITADELTRTVFMDLSGLRSEDTAVYYCARGYDSSAFRAFDIWGRGTTVTVSSGGGGSGGGGSGGGGSAQSVLTQPPSASRTPRQRVTISCSGSRSNIGENYVYWYQQLPGTAPKLLIYKNNQRPSGVPDRFSGSRSGTSASLAISGLRSEDEAVYYCASWDDSLSGPVFGRGTKVSVLG

SEQ ID NO: 1249 - protein, 253 aa, Homo sapiens
QVQLVQSGVEVKKPGASVKVSCKASGYTFSNHGISWVRQAPGQGLEWVGWISGHDDSTKYAQKFQGRVTMTADTSTSTAYIELRSLKSDDTAVYYCARPFYDTLTSYVFQYFDHWGQGTLVTVSSGGGGSGGGGSGGGGSAQSVLTQPPSASGSPGQSVTISCTGTSGDVGRYNFVSWYQQYPGKAPKLMIYEVTKRPSGVPHRFSGSKSGNTASLTVSGLQAEDEAVYYCSSYAGSINLGVFGGGTKLTVLG

SEQ ID NO: 1250 - protein, 260 aa, Homo sapiens
QVQLVQSGAEVKKPGSSVKVSCKASGGALSSDAISWVRQAPGQGLEWMGGIIPTFRKTKYAQKFQGRVTITADELTRTVFMELSSLKSEDTAVYYCARGRKDTDKVKPWDRYYHYYYMDVWGRGTLVTVSSGGGGSGGGGSGGGGSALSYVLTQPPSASGTPGQRVTISCSGSFSNIGTNTVNWYQHLPGTAPRLLIFNNSQRPSGVPDRFSGSKSGTSASLAISGLQSEDEADYYCAAWDDSLSGHVVFGGGTKLTVLG

SEQ ID NO: 1251 - protein, 248 aa, Homo sapiens
QVQLVQSGAEVRKPGSSVKVSCKASGGSFSSHVFSWVRQAPGQGLEWVGGITPKFATPNYAQKFQHRVTITADELTRTVFMDLSGLRSEDTAVYYCARGYDSSAFRAFDIWGRGTLVTVSSGGGGSGGGGSGGGGSALSSELTQDPAVSVALGQTVRITCQGDSLRSYSASWYQQKPGQAPLLVIYGKNNRPSGIPDRFSGSSSGNTASLTITGAQAEDEADYYCSSRDNSDNHLVVFGGGTKLTVLG

SEQ ID NO: 1252 - protein, 257 aa, Homo sapiens
QVQLVQSGAEVKKPGSSVKVSCKASGGALSSDAISWVRQAPGQGLEWMGGIIPTFRKTKYAQKFQGRVTITADELTRTVFMELSSLKSEDTAVYYCARGREDTDKVKPWDRYYHYYYMDVWGRGTLVTVSSGGGGSGGGGSGGGGSALSSELTQDPAVSVALGQTVRITCQGDSLRSYYANWYQQKPGQAPVLVIYGKNNRPSGIPDRFSASTSGNTGSLSITGAQAEDEADYYCSSRDSSGNHWVFGGGTKVTVLG

SEQ ID NO: 1253 - protein, 256 aa, Homo sapiens
EVQLVQSGPEVKKPGSSVKVSCRTSGGTFRNYGLSWVRQAPGQGLEWMGGVIPISSTIKYGQKFQDRLTIVADDLTNTTYMELSSLRPEDTAVYYCARAATTSQKHNKYAYYFYGMDVWGRGTLVTVSSGGGGSGGGGSGGGGSALPVLTQPPSASGTPGQRVTISCSGSTSNIGSNAVNWYQQLPGTAPKLLIYSNNQRPSGVPDRFSGSKSATSASLAISGLQSEDEGDYYCAAWDDSLYGWVFGGGTKVTVLG

SEQ ID NO: 1254 - protein, 248 aa, Homo sapiens
QVQLVQSGAEVRKPGSSVKVSCKASGGSFSSHVFSWVRQAPGQGLEWVGGITPKFATPNYAQKFQHRVTITADELTRTVFMDLSGLRSEDTAVYYCARGYDSSAFRAFDIWGRGTTVTVSSGGGGSGGGGSGGGGSAQSVLTQPPSASGTAGQRVTISCSGSRSNIGENYVYWYQQLPGTAPKLLIYKNNQRPSGVPDRFSGSRSGTSASLAISGLRSEDEAVYYCASWDDSLSGPVFGRGTKVTVLG

SEQ ID NO: 1255 - protein, 258 aa, Homo sapiens
QVQLVQSGAEVKKPGSSVKVSCKASGGALSSDAISWVRQAPGQGLEWMGGIIPTFRKTKYAQKFQGRVTITADELTRTVFMELSSLKSEDTAVYYCARGREDTDKVKLWDRYYHYYYMDVWGQGTLVTVSSGGGGSGGGGSGGGGSAQSVLTQPPSASGTPGQRVTISCSGSTSNIVSNYVYWYQQLPGTAPKLLIYRNNQRPSGVPDRFSGSKSGTSASLAISGLRSEDEADYYCAAWDDSLSGWVFGGGTKLTVLG

SEQ ID NO: 1256 - protein, 257 aa, Homo sapiens
QVQLVQSGAEVKKPGSSVKVSCKASGGTFSNYTISWVRQAPGQGLEWMGGILPMFGTESYGQKFQDRVTITADELTRIVYMELNSLRSEDTAVYYCARVRPKLRYFDWLSRHDAFDLWGRGTMVTVSSGGGGSGGGGSGGGGSAQAVLTQPSSISGAPGQRVTISCSGTSPNIGAGDEIHWYQVSPGKAPRLLIYSNINRPSGVPDRFSGSKSGTTASLTITGLRPEDEADYYCQSYDRVVSGSVVFGGGTKLTVLG

SEQ ID NO: 1257 - protein, 247 aa, Homo sapiens
QVQLVQSGAEVRKPGSSVKVSCKASGGSFSSHVFSWVRQAPGQGLEWVGGITPKFATPNYAQKFQHRVTITADELTRTVFMDLSGLRSEDTAVYYCARGYDSSAFRAFDIWGRGTLVTVSSGGGGSGGGGSGGGGSALSSELTQDPAVSVALGQTVKITCQGESLRGYYASWYQQKPGQAPVLVIYGRNNRPSGIPDRFSGSSSGNTASLTITGAQAEDEADYYCNSRDSSGNHYVFATGTKVTVLG

SEQ ID NO: 1258 - protein, 256 aa, Homo sapiens
EVQLVQSGAEVKKPGSSVKVSCRVSGGSFIDDSINWLRQAPGQGLEWVGGTIPLANRANYAQKFRDRVTITADELTATVFLELTSLRSDDTALYYCARSSPPKWYDALTGDSSYHSAMDVWGRGTMVTVSSGGGGSGGGGSGGGGSALSSELTQDPAVSVALGQTVSITCQGDSLRNYYASWYLQKPGQAPLLVVYGKNKRPSGIPERVSGSSSEDTASLTITGAQAEDEADYYCNSRDSSGNVVFGGGTKLTVLG

SEQ ID NO: 1259 - protein, 254 aa, Homo sapiens
QVQLVQSGAVAKEPGSSVTVSCRASGGSFSTYAFSWVRQAPGQGLEWMGGIIPKSGPTNYAQKFQGRVTISADELTRTIYMELTSLRSEDTAVYYCARDKAHGEYGRDYYYYYGMDVWGRGTMVTVSSGGGGSGGGGSGGGGSALSSELTQDPAVSVALGQTVRITCQGDILRSYYAGWYQQKPGQAPVLVVYGKNNRPSGIPDRFSGSTSGNTASLTITGAQAEDEADYFCNSRDTSGKQWVFGGGTKVTVLG

SEQ ID NO: 1260 - protein, 258 aa, Homo sapiens
QVQLVQSGAEVSKPGSSVKVSCRASGGSLIDYSINWVRQAPGQGLEWVGGTVPLANTANYAQKFRGRVTITADELTATVFLELTSLRSDDTALYYCAKSSPPKWYDALTGHSSYHSAMDVWGQGTMVTVSSGGGGSGGGGSGGGGSAQSVLTQPPSVSAAPGQKVTISCSGSSSNIGNNYVSWYQQLPGTAPKLLIYDNNKRPSGIPDRFSGSKSGTSATLGITGLQTGDEADYYCGAWDSSLSAYVFGSGTKLTVLG

SEQ ID NO: 1261 - protein, 257 aa, Homo sapiens
QVQLVQSGAEVSKPGSSVKVSCRASGGTFIDYSINWVRQAPGQGLEWVGGTIPLANTANYAQKFRGRVTITADELTATVFLELTSLRSDDTALYYCAKSGPPKWYDALTGHSSYHSAMDVWGRGTLVTVSSGGGGSGGGGSGGGGSALSSELTQDPAVSVALGQTVTITCQGASLRNYYASWYKQKPPQAPVLLVYGKNNRSSGIPDRFSGSRSGNIASLTITGTQAEDEADYYCNSRDSSGDHVVIGGGTKVTVLG

SEQ ID NO: 1262 - protein, 259 aa, Homo sapiens
QVQLVQSGAEVKKPGSSVKVSCRASGGSFIDDSINWLRQAPGQGLEWVGGTIPLANRANYAQKFRDRATITGDELTATVFLELTSLRSDDTALYYCARSSPPKWYDALTGHSSYHSAMDVWGRGTLVTVSSGGGGSGGGGSGGGGSAQSVLTQPPSASGTPGQRVTISCSGTNSNIGGNTVNWYQQLPGTAPRLLIYSNNQRPSGVPDRFSGSKSGTSASLAISGLQSEDEADYYCAARDDRLNAHVVFGGGTKVTVLG

SEQ ID NO: 1263 - protein, 259 aa, Homo sapiens
QVQLVQSGAEVKKPGSSVKVSCKASGGALSSDAISWVRQAPGQGLEWMGGIIPTFRKTKYAQKFQGRVTITADELTRTVFMELSSLKSEDTAVYYCARGREDTDKVKPWDRYYHYYYMDVWGRGTLVTVSSGGGGSGGGGSGGGGSAQSVLTQPPSVSGAPGQGVTISCTGSSSNIGARFDVHWYRQLPGTAPQLLIYGNRNRPSGVPDRFSGSKSGTSASLAITGLQAEDEADYYCQSYDSRLSGYVFGTGTKLTVLG

SEQ ID NO: 1264 - protein, 246 aa, Homo sapiens
QVQLVQSGAEVRKPGSSVKVSCKASGGSFSSHVFSWVRQAPGQGLEWVGGITPKFATPNYAQKFQHRVTITADELTRTVFMDLSGLRSEDTAVYYCARGYDSSAFRAFDIWGKGTLVTVSSGGGGSGGGGSGGGGSALEIVLTQSPGTLSLSPGERATLSCRASQSVSSSYLAWYQQKPGQAPRLLIYGASSRATGIPDRFSGSGSGTDFTLTISRLEPEDFAVYYCQQYGSSLTFGGGTKVEIKR

SEQ ID NO: 1265 - protein, 258 aa, Homo sapiens
QVQLVQSGAEVKKPGSSVKVSCRVSGGSFIDDSINWLRQAPGQGLEWVGGTIPLANRANYAQKFRDRVTITADELTATVFLELTSLRSDDTALYYCARSSPPKWYDALTGDSSYHSAMDVWGRGTTVTVSSGGGGSGGGGSGGGGSAQPVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGWVFGGGTKLTVLG

SEQ ID NO: 1266 - protein, 258 aa, Homo sapiens
QVQLVQSGAEVKKPGSSVKVSCRASGGSFIDDSINWLRQAPGQGLEWVGGTIPLANRANYAQKFRDRVTITADELTATVFLELTSLRSDDTALYYCARSSPPKWYDALTGHSSYHSAMDVWGQGTLVTVSSGGGGSGGGGSGGGGSAQSVLTQPPSASGAPGQRVTISCSGSSSNIGSNTVSWYQQLPRTAPKVVIYSNKQRPSGVPDRFSGSKSGTSASLAISGLQAEDEADYYCAAWDDTLNGPVFGIGTKLTVLG

SEQ ID NO: 1267 - protein, 248 aa, Homo sapiens
QVQLVQSGAEVRKPGSSVKVSCKASGGSFSSHVFSWVRQAPGQGLEWVGGITPKFATPNYAQKFQHRVTITADELTRTVFMDLSGLRSEDTAVYYCARGYDSSAFRAFDIWGRGTTVTVSSGGGGSGGGGSGGGGSAQSVLTQPPSASGTPGQRVTISCSGSRSNIGENYVYWYQQLPGAAPKLLIYKNNQRPSGVPDRFSGSRSGTSASLAISGLRSEDEAVYYCASWDDSLSGPVFGRGTKVSVLG

SEQ ID NO: 1268 - protein, 246 aa, Homo sapiens
QVQLVQSGAEVRKPGSSVKVSCKASGGSFSSHVFSWVRQAPGQGLEWVGGITPKFATPNYAQKFQHRVTITADELTRTVFMDLSGLRSEDTAVYYCARGYDSSAFRAFDIWGQGTLVTVSSGGGGSGGGGSGGGGSALETTLTQSPATLSVSPGERATLSCRASQSVSSNLAWYQQKPGQAPRLLIYGASTRATGIPARFSGSGSGTEFTLTISSLQSEDFAVYYCQQYNNWPKTFGQGTRLEIKR

SEQ ID NO: 1269 - protein, 247 aa, Homo sapiens
QVQLVQSGAEVKKPGASVKVSCKASGYRFLSYGISWVRQAPGQGLEWMGWISTDSGRTKQAQNFQGRVIMTTDTLTTTVFLEVRNLRSDDSAVYYCARDTVRSGGMDVWGRGTLVTVSSGGGGSGGGGSGGGGSALSYVLTQPPSASGTPGQRVTISCSGSFSNIGRNTVNWYQQLPGTAPKLLIYKNNQRPSGVPDRISGSKSGTSASLAINGLQSEDEADYYCAAWDDSLEGYVFGTGTKLTVLG

SEQ ID NO: 1270 - protein, 259 aa, Homo sapiens
QVQLVQSGAEVKKPGSSVKVSCKASGGALSSDAISWVRQAPGQGLEWMGGIIPTFRKTKYAQKFQGRVTITADELTRTVFMELSSLKSEDTAVYYCARGREDTDKVKPWDRYYHYYYMDVWGKGTLVTVSSGGGGSGGGGSGGGGSAQAVLTQPSSVSGAPGQRVTISCTGSSSNIGAGYNVHWYRQFPGAPPQLLIYRNTNRPSGIPDRFSGSKSDASASLAITGLQAEDEADYYCESYDNSLSGSIFGGGTKVTVLG

SEQ ID NO: 1271 - protein, 255 aa, Homo sapiens
QVQLVQSGAVAREPGSSVTVSCRASGGSFSSYAFSWVRQAPGQGLEWMGGIIPKSGPTNYAQKFRGRVTISADELTRTIYMELSSLRSEDTAVYYCARDKAHGEYGRDYYYYYGMDVWGRGTLVTVSSGGGGSGGGGSGGGGSAQAVLTQPSSVSEVPGQTVTISCSGSSFNIGKHPVNWYHQVPGKAPKLLIYYNNLRSSGVSDRFSGSKSGTSASLAIRGLVSDHEGDYYCSAWDDTLRGWVFGGGTKLTVLG

SEQ ID NO: 1272 - protein, 249 aa, Homo sapiens
QVQLVQSGAEVRKPGSSVKVSCKASGGSFSSHVFSWVRQAPGQGLEWVGGITPKFATPNYAQKFQHRVTITADELTRTVFMDLSGLRSEDTAVYYCARGYDSSAFRAFDIWGQGTMVTVSSGGGGSGGGGSGGGGSAQSVLTQPPSASGTPGQRVTISCSGSNSNIGGNTVNWYQQLPGTAPRLLIYSNNQRPSGVPDRFSGSKSGTSASLAISGLQSEDEADYYCAARDDRLNAHVVFGGGTKLTVLG

SEQ ID NO: 1273 - protein, 248 aa, Homo sapiens
QVQLVQSGAEVRKPGSSVKVSCKASGGSFSSHVFSWVRQAPGQGLEWVGGITPKFATPNYAQKFQHRVTITADELTRTVFMDLSGLRSEDTAVYYCARGYDSSAFRAFDIWGQGTLVTVSSGGGGSGGGGSGGGGSAQSVLTQPPSASGTPGQRVTISCSGSSSNIIRNYAYWYQQFPGAAPKLLIYRDNQRPSGVPDRFSASKSGTSASLAISGLRSEDEADYYCAGWDDSLSGPVFGGGTKLTVLG

SEQ ID NO: 1274 - protein, 258 aa, Homo sapiens
QVQLVQSGAEVKKPGSSVKVSCRASGGSFIDDSINWLRQAPGQGLEWVGGTIPLANRANYAQKFRDRVTITADELTATVFLELTSLRSDDTALYYCARSSPPKWYDALTGHSSYHSAMDVWGRGTLVTVSSGGGGSGGGGSGGGGSAQSVVTQPPSASATPGQRVTISCSGSRSNIGGNTVNWYQQLPGTAPKLLIYGLNQRPSGVPDRFSGSKSGTSASLAISGLQSDDEADYYCSSWDDSLDGPVFGGGTKLTVLG

SEQ ID NO: 1275 - protein, 259 aa, Homo sapiens
EVQLVQSGAEVKKPGSSVKVSCKASGGALSSDAISWVRQAPGQGLEWMGGIIPTFRKTKYAQKFQGRVTITADELTRTVFMELSSLKSEDTAVYYCARGREDTDKVKPWDRYYHYYYMDVWGRGTLVTVSSGGGGSGGGGSGGGGSAQSVLTQPPSVSGAPGQRVTISCSGSSSIIGAGYDVHWYQQFPGTAPKLLIYGSNNRPSGVPDRFSGSKSGTSASLAITGLQAEDEADYYCQSYDSSLSGSFFGGGTKLTVLG

SEQ ID NO: 1276 - protein, 258 aa, Homo sapiens
EVQLVQSGAEVKKPGSSVKVSCKASGGALSSDAISWVRQAPGQGLEWMGGIIPTFRKTEYAQKFQGRVTITADELTRTVFMELSSLKSEDTAVYYCARGREDTDKVKPWDRYYHYYYMDVWGRGTLVTVSSGGGGSGGGGSGGGGSAQSVLTQPPSVSAAPGQKVTISCSGSSSNIGKKSVSWYQQVPGTAPRLLIYDNNKRPSGIPDRFSGSKSGTSATLGITGLQTGDEADYYCATWDNSLGVWAFGGGTKLTVLG

SEQ ID NO: 1277 - protein, 259 aa, Homo sapiens
QVQLVQSGAEVKKPGSSVKVSCRVSGGSFTDDSINWLRQAPGQGLEWVGGTIPLANRANYAQKFRDRVTITADELTATVFLELTSLRSDDTALYYCARSSPPKWYDALTGDSSYHSAMGVWGRGTLVTVSSGGGGSGGGGSGGGGSALSYVLTQPPSASGTPGQRVTISCSGSNSNIGSNPVNWYQQLPGTAPKLLIYNDNQRPSGVPDRFSGPKSGTSASLAISGLQSEDEADYYCSVWDDSLNGPVFGGGTKLTVLG

SEQ ID NO: 1278 - protein, 263 aa, Homo sapiens
QVQLVQSGAEVKKPGSSVKVSCRASGGALSSDAISWVRQAPGQGLEWMGGIIPTFRKTKYAQKFQGRVTITADELTRTVFMELSSLKSEDTAVYYCARGREDTDKVKPWDRYYHYYYMDVWGQGTLVTVSSGGGGSGGGGSGGGGSAQAVLTQPSSLSASPGTSATLTCALRSDISVADYKIFWYHQKPGSPPQSLLSYKSDSDKEQGSGVPSRFSGSSDASANAGILLISGLQSEDEADYYCVIWYKNAWVFGGGTKLTVLG

SEQ ID NO: 1279 - protein, 256 aa, Homo sapiens
EVQLVQSGPEVKKPGSSVKVSCRTSGGTFRNYGLSWVRQAPGQGLEWMGGVIPISSTIKYGQKFQDRLTIVADDLTNTTYMELSSLRPEDTAVYYCARAATTSQKHNKYAYYFYGMDVWGQGTLVTVSSGGGGSGGGGSGGGGSAQSVLTQPPSVSGTPGQRVTISCSGSSSNIGNDVVNWYQQLPGTAPKLLIYNDYQRPSGVPDRFSGSKSGTSAYLAISGLQSEDEADYHCAVWDDSLDGWVFGGGTKLTVLG

SEQ ID NO: 1280 - protein, 250 aa, Homo sapiens
QMQLVQSGAEVRKPGSSVKVSCKASGGSFSSHVFSWVRQAPGQGLEWVGGITPKFATPNYAQKFQHRVTITADELTRTVFMDLSGLRSEDTAVYYCARGYDSSAFRAFDIWGRGTMVTVSSGGGGSGGGGSGGGGSAQSVLTQPPSVSGAPGQRVTISCTGTSSNIGAGFDVHWYQQLPGTAPKLLIYGSSNRPSGVPDRFSGSKSGTSASLAITGLQAEDEADYYCQSYDNLSGSNWVFGGGTKLTVLG

SEQ ID NO: 1281 - protein, 255 aa, Homo sapiens
QVQLVQSGAEVKKPGSSVKVSCQASGGTFRTHAFHWVRQAPGEGLEWMGGIIPKFGTPNYAQKFQDRVTIIADELTSTVYMELSSLRSEDTAVYFCAIAKGYYYDSSGASDVFDVWGQGTLVTVSSGGGGSGGGGSGGGGSAQAVLTQPSSVSRAPGQRVTVSCTGSSSNIGAGFDVNWFQQLPGAAPRLVIYGNKNRPSGVPDRFSGSKSGTSASLVITGLQAEDEADYYCQSYDSSQGGSRVFGGGTKLTVLG

SEQ ID NO: 1282 - protein, 260 aa, Homo sapiens
EVQLVQSGAEVKKPGSSVKVSCKASGGALSSDAISWVRQAPGQGLEWMGGIIPTFRKTKYAQKFQGRVTITADELTRTVFMELSSLKSEDTAVYYCARGREDTDKVKPWDRYYHYYYMDVWGQGTTVTVSSGGGGSGGGGSGGGGSAQAVLTQPSSVSGAPGQRVTISCTGSSSNIGTGYDVHWYQQLPGTAPKLLIYGNNNRPSGVPDRFSGSKSGTSASLAITGLQAEDEADYYCQSYDSSLSAPYVFGTGTKVTVLG

SEQ ID NO: 1283 - protein, 257 aa, Homo sapiens
QVQLVQSGAVAREPGSSVTVSCRASGGSFSSYAFSWVRQAPGQGLEWMGGIIPKSGPTNYAQKFRGRVTISADELTRTIYMELSSLRSEDTAVYYCARDKAHGEYGRDYYYYYGMDVWGRGTLVTVSSGGGGSGGGGSGGGGSAQSVLTQPPSASGTPGQRVTISCSGSSSNIGSNYVYWYQQLPGTAPKLLIYTNNQRPSGVPDRFSGSKSGTSASLTISGLRSEDEAYYYCAAWDDNLSAPRGVFGGGTKLTVLG

SEQ ID NO: 1284 - protein, 255 aa, Homo sapiens
QMQLVQSGAVAREPGSSVTVSCRASGGSFSSYAFSWVRQAPGQGLEWMGGIIPKSGPTNYAQKFRGRVTISADELTRTIYMELSSLRSEDTAVYYCARDKAHGEYGRDYYYYYGMDVWGRGTLVTVSSGGGGSGGGGSGGGGSALPVLTQPPSASGAPGQRVTISCSGDNSNIGENVVYWYQQLRGTAPKLLIYRNYQRPSGVPDRFSGSKSGTSASLAISGLRSEDEADYYCASWDDSLRTWMFGGGTKLTVLG

SEQ ID NO: 1285 - protein, 256 aa, Homo sapiens
EVQLVQSGAEVKKPGSSVKVSCQVSGGRFNSYGISWVRQAPGQGLEWMGGLIPMFGPAKYAQRFQGRVTITADTLTNTAYMELSSLTSEDTAVYYCARDRGYTGYDRLVGGYYFDFWGKGTLVTVSSGGGGSGGGGSGGGGSAQAVLTQPSSVSGAPGQRVTISCTGSSSNIGGRYEVNWYQQLPGRAPKVLIYVNNNRPSGVSGRFSGFKSGTSAYLAITGLQAEDEADYYCQSRDSGLGDSVVFGGGTKVTVLG

SEQ ID NO: 1286 - protein, 246 aa, Homo sapiens
EVQLVQSGAEVKKPGASVKVSCKASGYRFLSYGISWVRQAPGQGLEWMGWISTDSGRTKQAQKFHRRVIMTTDTLTTTVFLELRNLRSDDSAVYYCARDTVRSGGMDVWGQGTMVTVSSGGGGSGGGGSGGGGSAQSVLTQPPSASGTPGQTVTMSCSGSSSNIGPNTVNWYQQLPGTAPKLLIYSNDQKPSGVPDRFSGSKSGTSASLAIRGLQSEDEADYYCSTWDDSLKGRVFGGGTKLTVLG

SEQ ID NO: 1287 - protein, 254 aa, Homo sapiens
QVQLQQSGPGLVKPSQILSLTCAISGDSVASNGAAWNWIRQSPSRGLEWLGRTYYRSKWYVDYAVSVKSRITINPDTSKNQFSLQLNSVTPEDTAVYYCARDRYDILTGYYYYGMDVWGQGTMVTVSSGGGGSGGGGSGGGGSQSALTQPASVSGSRGQSITISCTGTTGDVGGYDYVSWYQQHPGKAPKLLIYGISNRPSGVPDRFSASKSGNTASLTISGLQAEDEADYFCSTYAPPGIIMFGGGTKLTVLG

SEQ ID NO: 1288 - protein, 254 aa, Homo sapiens
QVQLQQSGPGLVKPSQILSLTCAISGDSVASNGAAWNWIRQSPSRGLEWLGRTYYRSKWYVDYAVSVKSRITINPDTSKNQFSLQLNSVTPEDTAVYYCARDRYDILTGYYYYGMDVWGQGTMVTVSSGGGGSGGGGSGGGGSQSALTQPASVSGSRGQSITISCTGTTGDVGGYDYVSWYQQHPGKAPKLLIYGNSNRPSGVPDRFSASKSGNTASLTISGLQAEDEADYFCSTYAPPGIIMFDGGTKLTVLG

SEQ ID NO: 1289 - protein, 254 aa, Homo sapiens
QVQLQQWGGGVVQPGRSLRLSCAASGFTFSSYGMHWVRQAPGKGLEWVAVISYDERIKNYGDSVKGRFTGSRDDSKNTLYLEMNSLRPEDTAVYYCATEVRNYDLLTRSYLAGPLDNWGKGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1290 - protein, 249 aa, Homo sapiens
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREMGYDILTGYYLNYMDVWGRGTLVTVSSGGGGSGGGGSGGGGSSELTQDPAVSVALGQTVRITCQGDSLRSYYTNWFQQKPGQAPLLVVYAKNKRPSGIPDRFSGSSSGNTASLTITGAQAEDEADYYCHSRDSSGNHVLFGGGTKLTVLG

SEQ ID NO: 1291 - protein, 245 aa, Homo sapiens
QVQLQQSGAEVKKPGSSVKVSCKMSGGTFSTYSVTWVRQAPGQGLEWMAKIIPNINKIEYAENLHDRLSIAADTSTDTVYMELSRLRSEDTAVYYCARGDYDILTGYYMDVWGKGTLVTVSSGGGGSGGGGSGGGGSDIVMTQSPSTLSASVGDRVTITCRASQGISSWLAWYQQKPGRAPKVLIYKASTLESGVPSRFSGSGSGTDFTLTISSLQPEDFATYYCQQSYSTPWTFGQGTKLEIKR

SEQ ID NO: 1292 - protein, 251 aa, Homo sapiens
QVQLQQSGAEVKKPGASVKVSCKASGYTFTKYTMHWLRQAPGQGPEWMGWINGGSGDTKYSRKFLGRVTITKDTSASAAYMELSSLGSEDTALYYCARATYDPLTGYSFDGFDIWGKGTLVTVSSGGGGSGGGGSGGGGSQSVLTQPASVSGSPGQSITISCTGTSSDVGGYNYVSWYHQHPGKAPKLMIYEGSKRPSGVSNRFSGSKSGNTASLTISGLQAEDEADYYCSSYTTRSTRVFGGGTKLTVLG

SEQ ID NO: 1293 - protein, 248 aa, Homo sapiens
QVQLQQSGAKVKKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGRGTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1294 - protein, 247 aa, Homo sapiens
QVQLVQSGGGLVKPGGSLRLSCAASGFTFSDYYMSWIRQAPGKGLERVSYISSSSSYIYYADSVKGRFTISRDNAKNSLYLQMNSLRAEDTAVYYCARVKRDILTGYVEGMDVWGKGTTVTVSSGGGGSGGGGSGGGGSSELTQDPAVSVALGQTVRITCQGGSLRSYYASWYQQKPGQAPVLVIYGKNNRPSGIPDRLSGSSSGNTASLTITGAQAEDEADYYCNSRDSSGNHVVFGGGTKLTVLG

SEQ ID NO: 1295 - protein, 254 aa, Homo sapiens
QVQLQESGGGLVQPGGSLRLSCAASGFTFSGSVMSWVRQAPGKGLEWVSAISGSGSSTYYADSVKGRFTISRGNSNNTLYLQMNSLRAEDTAVYYCAKGGPHYDILTGYYMAVGFDIWGQGTTVTVSSGGGGSGGGGSGGGGSQSALTQPASVSGSRGQSITISCTGTTGDVGGYDYVSWYQQHPGKAPKLLIYGNSNRPSGVPDRFSASKSGNTASLTISGLQAEDEADYFCSTYAPPGIIMFGGGTKLTVLG

SEQ ID NO: 1296 - protein, 249 aa, Homo sapiens
QVQLVQSGADVKKPGSSVKVSCKASGGNFNSYAISWVRQAPGQGPEWMEGFIPVFRTVQYSKKFQDRVTITADELTRTVYMELRSLRYDDTAMYYCARDIDARLAALDAFDIWGRGTMVTVSSGGGGSGGGGSGGGGSQSVLTQPPSASGTPGQRVTISCSGSSSNIGSNTVNWYQRLPGAAPQLLIYNNDQRPSGIPGRFSGSKSGTSGSLVISGLQSEDEADYYCASWDDSLNGRVFGGGTKLTVLG

SEQ ID NO: 1297 - protein, 251 aa, Homo sapiens
QVQLQQSGAEVKKPGSSVKVSCKASGYTFTKYTMHWVRQAPGQGPEWMGWINGGSGDTKYSRKFQGRVTITKDTSASAAYMELSSLGSEDTALYYCARATHDPLTGYSFDGFDIWGRGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1298 - protein, 253 aa, Homo sapiens
QVQLQQSGAEVKKPGSSVKVSCKASGGTFSSYAISWVRQAPGQGLEWMGGIIPTLGTTNYAQNFQGRVTITADRLTSTAYMELSSLTSEDTAVYFCARHRSRSCSSTSCRNDAFDIWGKGTMVTVSSGGGGSGGGGSGGGGSQSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLG

SEQ ID NO: 1299 - protein, 249 aa, Homo sapiens
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREMGYDILTGYYLNYMDVWGRGTLVTVSSGGGGSGGGGSGGGGSSELTQDPAVSVALGQTVRITCQGDSLRSYYTNWFQQKPGQAPLLVVYAKNKRPSGIPDRFSGSSSGNTASLTITGAQAEDEADYYCHCRDSSGNHVLFGGGTKLTVLG

SEQ ID NO: 1300 - protein, 246 aa, Homo sapiens
KVQLVQSGAELKRPGSSVKVSCKVSGGTFKYYSYSWIRQAPGHWPEWMGGINVIRDTANYAQEFRGRATITADQLTTTVYMELSSLGSEDTAMYFCATEGAADYLNGQYFQDWGKGTLVTVSSGGGGSGGGGSGGGGSSELTQDPAVSVALGQTVRITCQGDSLRSYYASWYQQKPGQAPVLVIYGKINRPSGIPDRFSGSSSGNTASLTITGAQAEDEADYYCNSRDSSGNHVVFGGGTKLTVLG

SEQ ID NO: 1301 - protein, 256 aa, Homo sapiens
QVQLLQSAAEVKKPGASVNVSCKASGYSFIDYYLHWVRQAPGQGLEWMGWINPKSGDTNYAQRFQGRVTMTRDTSTSTVYMELSSLRSEDTAVYYCARQKVYYDILTGYNYYYYGMDVWGRGTMVTVSSGGGGSGGGGSGGGGSQSVLTQPPSVSAAPGQKVTISCSGSTSNIGNNYVSWYQQHPGKAPKLMIYDVSKRPSGVPDRFSGSKSGNSASLAITGVQAEDEADYYCQSYDSSLRGSRVFGTGTKVTVLG

SEQ ID NO: 1302 - protein, 254 aa, Homo sapiens
GVQLVQSGGGVVQPGRSLRLSCAASGFDFSTYGMHWVRQAPGKGLEWVAVISYDGSNKYYADSAKGRFTISRDNSQNMLYLQMNSLRPEDTAVYYCATEVRNYDLLTRSYLAGPLDNWGKGTMVTVSSGGGGSGGGGSGGGGSQSVLTQPASVSGFPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1303 - protein, 241 aa, Homo sapiens
GVQLVQSGAEVKKPGASVKLSCKASGYTFSGYYIHWVRQAPGQGLEWMGRIKANSGATNYAQKFQGRVTFTADKLTRTVFMELISLRSEDSAMYYCARDIDIGGDDSWGRGTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1304 - protein, 253 aa, Homo sapiens
QVQQSGAEVKKPGGSLRLSCAASGFTFSSYSMNWVRQAPGKGLEWVSSISSSSSYIYYADSVKGRFTISRDNAKNSLYLQMISLRAEDSAVYYCAREGGNYDILTGYYIGNGAFDIWGRGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1305 - protein, 249 aa, Homo sapiens
EVQLVQSGAEVKKPGSSVKVSCKVSGGTFASYAISWVRQAPGQGLEWMGGTIPIFGSAKHTQKFQDRVSITADKLTTTVFLELTSLTSDDTAVYYCARPQGVTLVRGAETDAFAIWGQGTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1306 - protein, 248 aa, Homo sapiens
QVQLVQSGAEVKKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGKGTPVTVSSGGGGSGGGGSGGGGSSELTQDPAVSVALGQTVRITCQGDSLRSYYTNWFQQKPGQAPLLVVYAKNNRPSGIPDRFSGSSSGNTASLTITGAQAEDEADYYCNSRDSSGNHVVFGGGTKLTVLG

SEQ ID NO: 1307 - protein, 247 aa, Homo sapiens
AQLQQSGAEVKKPGASVKVSCKTSGYTFTKYTMHWVRQAPGQGPEWMGWINGGSGDTKYSRKFQGRVTITKDTSASAAYMELSSLGSEDTALYYCARATYDPLTGYSFDGFDIWGKGTMVTVSSGGGGSGGGGSGGGGSSELTQDPAVSVALGQTVRITCQGDSLRSYYTNWFQQKPGQAPVLVIYGKNNRPSGIPDRFSGSSSGNTASLTITGAQAEDEADYYCNSRDSSGNHVVFGGGTKLTVLG

SEQ ID NO: 1308 - protein, 246 aa, Homo sapiens
QVQLVQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHYGMDVWGRGTMVTVSSGGGGSGGGGSGGGGSSELTQDPAVSVALGQTVRITCQGDSLRSYYASWYQQKPGQAPVLVIYGKNNRPSGIPDRFSGSSSRNTASLTITGAQAEDEADYYCNSRDSSGNHVVFGGGTKLTVLG

SEQ ID NO: 1309 - protein, 251 aa, Homo sapiens
QITLEESGGGVVQPGRSLRLSCAASGFTFSSYGMHWVRQAPGKGLEWVALIWYDGSKKYYADSVKGRFTVSRDNSKNTLYLQMNSLRAEDTAVYYCARSHYDILTRLNYWYFDLWGRGTLVTVSSGGGGSGGGGSGGGGSQSVLTQPPSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLG

SEQ ID NO: 1310 - protein, 251 aa, Homo sapiens
QVTLKESGGGLVKAGGSLRLSCAASGFTFSSYAMTWVRQAPGKGLEWVSAISSSGDSASYADSVKGRFTTSRDNSKNTLYLQMNSLRAEDTAVYYCARDPGYYDILTGYFHRYGMDVWGRGTTVTVSSGGGGSGGGGSGGGGSDVVMTQSPSFLSAFVGDTITITCRASQGTYNYLAWYQQKPGKAPKLLIYAASTLQSGVPSRFSGSGSGTEFTLTISSLQPEDFGTYYCQQLISYPLTFGGGTKVEIKR

SEQ ID NO: 1311 - protein, 252 aa, Homo sapiens
GVQLVQSGGGLVQPGGSLRLSCAASGFTVSSNYMSWVRQAPGKGLEWVSVIYSGGSTYYADSVKGRFTISRDNSKNTLYLQMNSLRAEDTAVYYCARENGDYDILTGQTFYGMDVWGKGTTVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1312 - protein, 249 aa, Homo sapiens
QVQLVQSGAEVKKPGESLKISCKGSGYSFTKYWIGWVRQMPGKGLEWMGIIYPGDSNTRYSPSFQGQVTISADKSISTAYLQWSSLKASDTAMYYCARLYYDILTGYHWDAFDIWGQGTMVTVSSGGGGSGGGGSGGGGSQSVLTQPPSVSAAPGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1313 - protein, 250 aa, Homo sapiens
EVQLVQSGAEVKKPGASVKVSCKASGYTFTNYGITWVRQAPGQGLEWMGWISAYNGNRNYAQKLQGRVTMTTDTSTSTAYMELRSLRSDDTAVYYCVRDGIDILLVPAALMDVWGRGTTVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1314 - protein, 246 aa, Homo sapiens
EVQLMETGGGLVQPGGSLRISCAASGFTFSTYAMSWVRQAPGKGLEWVSGLSSGGGSTYYADSVKGRFTISRDNSKNILYLQMNSLRAEDTAIYYCAKSQWLEHDVFDIWGRGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1315 - protein, 251 aa, Homo sapiens
EVQLVQSGTEVKKPGASVKVSCKASGYTFSNNGISWVRQAPGQGLEWMGWISAYSGDTNYAQNLQGRVTMTTDTSTSTAYMELRSLRSDDTAVYYCARDRRDYDLLTRYYYYYGMDVWGRGTTVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1316 - protein, 251 aa, Homo sapiens
QVQLQQWGAGLLKPSETLSLTCDVYGGSFSGYYWTWIRQPPGKGLEWIGEIDYSGSANYDPSLKSRVAMSVDTSKKQFSLKLSSVTAADTAVYYCARKQRGDYDILTGYQLGYAFDIWGKGTMVTVSSGGGGSGGGGSGGGGSSELAQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1317 - protein, 251 aa, Homo sapiens
QITLKESGGGVVQPGRSLRLSCAASGFTFSSYGMHWVRQAPGKGLEWVALIWYDGSKKYYADSVKGRFTVSRDNSKNTLYLQMNSLRAEDTAVYYCARSHYDILTRLNYWYFDLWGRGTLVTVSSGGGGSGGGGSGGGGSQSVLTQPASVSGSPGQSITISCTGTSSDVGGYNYVSWYQQHPGKAPKLVIYEGSKRPSGVSNRFSGSKSGNTASLTISGLQAEDEADYYCSSYTTRSTRVFGGGTKLTVLG

SEQ ID NO: 1318 - protein, 256 aa, Homo sapiens
EVQLVQSGGGLVKPGGSLRLSCAASGFTFSSYSMNWVRQAPGKGLEWVSSISSSSSYIYYADSVKGRFTISRDNAKNSLYLQMNSLRAEDTAVYYCARDLGSFYDILTALRLENYGMDVWGKGTLVTVSPGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEAGYYCSSYTTRSTRVFGGGTKLTVLG

SEQ ID NO: 1319 - protein, 250 aa, Homo sapiens
EVQLVQSGGGLVQPGGSLRLSCAASGFTFSSHWMSWVRQAPGKGLEWVANIKQDGSEKYYVGSVKGRFTISRDNAKNSLYLQMNSLRAEDTAVYYCARDYYDILTKLPYGMDVWGQGTMVTVSSGGGGSGGGGSGGGGSQSVLTQPASVSGSLGQSITISCTGTSSDVGGYNYVSWYQQHPGKAPKLMIYEGSKRPSGVSNRLSGSKSGNTASLTISGLQAEDEADYYCSSYTTRSTRVFGGGTKLTVLG

SEQ ID NO: 1320 - protein, 251 aa, Homo sapiens
QVQLVESGGGVVQPGRSLRLSCAASGFNFNDYGMHWVRQAPGKGLEWVSGISWNSGTIGYAESVKGRFTISRDNAKNSLSLQMNSLRAEDTAVYYCARVSPSYDILTGYYLPHAFDVWGRGTTVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKR

SEQ ID NO: 1321 - protein, 249 aa, Homo sapiens
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGPRYYDILTGYRYNWFDPWGRGTLVTVSSGGGGSGGGGSGGGGSDIVMTQSPSTLSASVGDRVTITCRASQGISSWLAWYQQKPGRAPKVLIYKASTLESGVPSRFSGSGSGTDFTLTISSLQPEDFATYYCQQSYSTPWTFGQGTKLEIKR

SEQ ID NO: 1322 - protein, 247 aa, Homo sapiens
QVTLKESGGGLVKPGGSLRLSCSASGFTFGDYGFNWVRQAPGKGLEWVSSIGRGTSHRSYADSVKGRFTISRDNARNSLYLQMNSLRAEDTALYYCAKDIDDILTGYVLGMDVWGRGTMVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1323 - protein, 248 aa, Homo sapiens
EVQLVESGGGVVQPGGSLRLSCAASGFTVNSYAMHWVRQAPGKGLQWVAVISYDGSKKYYADSVKGRFTVSRDNSKNTLYLQMNSLRAEDTAVYYCARSHYDILTGLNYWYFDLWGKGTLVTVSSGGGGSGGGGSGGGGSSELTQDPAVSVALGQTVRITCQGDSLRSYYASWYQQKPGQAPELVIYGKNNRPSGIPDRFSGSSSGNTASLTITGAQAEDEADYYCNSRDSSGNHVVFGGGTKLTVLG

SEQ ID NO: 1324 - protein, 246 aa, Homo sapiens
QVQLVESGGGLVQPGRSLRLSCTASGFTFGDYAMSWVRQAPGKGLEWVSAISGSGGSTYYADSVKGRFTISRDNSKNTLYLQMNSLRAEDTAVYYCAKQQWLPYDAFDIWGQGTMVTVSSGGGGSGGGGSGGGGSQSVLTQPASVSGSPGQSITISCTGTSSDVGGYNYVSWYQQHPGKAPRLMIYEGSKRPSGVSNRFSGSKSGNTASLTISGLQAEDEADYYCSSYTTRSTRVFGGGTKLTVLG

SEQ ID NO: 1325 - protein, 250 aa, Homo sapiens
QVQLVQSGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTAYYDILTGYFFDIWGKGTQVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1326 - protein, 252 aa, Homo sapiens
QVQLQQWGAGLLKPSETLSLTCAVYGGSFSGYYWSWIRQPPGKGPEWIGKITHSGSTTYNPSLKSRVTMSVDTSTNQFSLKLNSVTAADTAVYYCARERADYDILTGYYFYGMDVWGQGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1327 - protein, 257 aa, Homo sapiens
QVQLQQSGPGLVKPSQTLSLTCDISGDSVSSNSAAWNWIRRSPSRGLEWLGRTYYRSKWYNDYAVSVKSRITINPDTSKNQFSLKLSSVTAADTAVYYCARERPYYDILTGYTVTYGMDVWGQGTTVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1328 - protein, 247 aa, Homo sapiens
EVQLVQSGAEEKEPGASVKVSCKASGYTFSRYAIHWVRQAPGQRLEWMGWINAGNGNTKYSQKFQGRVTITWDTSATTAYMELSSLRSEDTAVYYCARDEYDILTGLLQGMDVWGQGTMVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNRVVFGGGTKLTVLG

SEQ ID NO: 1329 - protein, 252 aa, Homo sapiens
QVQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARGDYDILTGYPLHAFDIWGKGTLVTVSSGGGGSGGGGSGGGGSQSVLTQPASVSGSPGQSITISCTGTSSAVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1330 - protein, 247 aa, Homo sapiens
QVQLQESGGGVVQPGRSLRLSCAASGFTFSSYGMHWVRQAPGKGLEWVAVISYDGSNKYYADSVKGRFTISRDNSKNTLYLQMNSLRAEDTAVYYCAKDGYDILTGYYFGMDVWGRGTTVTVSSGGGGSGGGGSGGGGSSELTQDPAVSVALGQTVRITCQGDSLRSYYTNWFQQKPGQAPLLVVYAKNKRPSGIPDRFSGSSSGNTASLTITGAQAEDEADYYCHSRDSSGNHVLFGGGTKLTVLG

SEQ ID NO: 1331 - protein, 248 aa, Homo sapiens
QVTLKESGAEVKKPGASVKISCKASGYAFINYAMHWVRQAPGQRLEWMGWINAGNGNTKYSQKFQGRVTMTRDTSTSTVYMELSSLRSEDTAVYYCAREHYDILTGYSLLGMDVWGRGTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1332 - protein, 251 aa, Homo sapiens
EVQLVQSGGGVVQPGRSLRLSCAASGFTFSSYGMHWVRQAPGKGLEWVALIWYDGSKKYYADSVKGRFTISRDNSKNTVYLQMNSLRAEDTGVYYCARSHYDILTGLNYWYFDLWGRGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1333 - protein, 253 aa, Homo sapiens
QVQLQQRGAGLLKPSETLSLTCAVYGESFSGYYWSWIRQPPGKGLEWIGEINHSGSTNYNPSLKSRVTISVDTSKNQFSLKLSSVTAADTAFYYCARGSLYYDILTGYYIGNAFDIWGRGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1334 - protein, 254 aa, Homo sapiens
EVQLVQSGAEVKKPGSSVKVSCKASGGTLSNFAISWVRQAPGQGLEWMGIINPSGGNTVYAQKFQGRVSMTRETSTSTVYMEMRSLRSEDTAVYYCARDGYYDILTGGFYYYYGMDVWGQGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1335 - protein, 249 aa, Homo sapiens
QMQLVQSGGGVVQPGGSLRLSCAASGFTFGDYAMHWVRQVPGKGLEWVSVIYSGGSTYYADSVKGRFTISRDNSKNTLYLQMNSLRAEDTAVYYCARGGYYDILTGYLVYYGMDVWGRGTVVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1336 - protein, 251 aa, Homo sapiens
GVQLVQSGPEVKKPGASVKVSCEASGYTFTDYYINWVRQAPGQGLEWMGWINPNNGATNYSQKLQGRVTLNRDTSTSTAYMELSGLRFEDTAVYFCARATYDPLTGYSFDGFDIWGRGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1337 - protein, 253 aa, Homo sapiens
QVQLVESGGGLEQPGGSLTLACAAAGFSFNSYAMNWVRQAPGKGLEWVAVISDDGSHKYYADSVKGRFTISRDSSKNTVYLQMNSLRTEDTALYYCARDQQYDILTGYHIDYYMDVWGQGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1338 - protein, 251 aa, Homo sapiens
VVQLVQSGAEVKKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGQGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1339 - protein, 253 aa, Homo sapiens
QVQLQESGPGLVKPSEPLSLTCVISGDSSSSYYWSWIRQPPGKGLEWIGNINYSGSTNYNPSLKNRITISVDASKNQLSLKLNSVTAADTAVYYCARHVRDYDILTGYYRGHHFDYWGRGTLITVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1340 - protein, 254 aa, Homo sapiens
QVQLQESGGGVVQPGRSLRLSCEASGFTFSSYGMHWVRQAPGKGLEWVAVISYDERIKNYGDSVKGRFTGSRDNSKNTLYLEMNSLRPEDTAVYYCATEVRNYDLLTRSYLAGPLDNWGKGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1341 - protein, 250 aa, Homo sapiens
QVQLQESGGGVVQPGGSLRLSCAASGFTFSGYGMHWVRQAPGKGLEWVASVRNDGSNTYYTDSVKGRFTISRDNTKNTLYLQMNSLRAEDTAVYYCARTESNYDILTGYYWPSMDVWGRGTLVTVSSGGGGSGGGGSGGGGSSELTQDPAVSVALGQTVRITCQGDSLRSYYTNWFQQKPGQAPLLVVYAKNKRPSGIPDRFSGSSSGNTASLTITGAQAEDEADYYCNSRDSSGNHVVFGGGTKLTVLG

SEQ ID NO: 1342 - protein, 251 aa, Homo sapiens
QVQLQQSGAEVKKPGASVKVSCKASGYSFSNYVMHWVRQAPGQGPEWMGWINGGSGDTKYSRKFQGRVTITKDTSASAAYMELSSLGSEDTALYYCARATYDPLTGYSFDGFDIWGKGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1343 - protein, 251 aa, Homo sapiens
QVQLQQSGAEVKKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGQGTMVTVSSGGGGSGGGGSGGGGSQSVLTQPESVSGSPAQSLTVSCTGHSSSVGGYNYVWWYQQPADKAVQVMNYKGSKRSSMVSNRFSGCKSGTAALITISGQQDEEEADYCYSSYTSSSPLVFGGGTKLTVLG

SEQ ID NO: 1344 - protein, 250 aa, Homo sapiens
KVQLVQSGGGQVVRGGSLRLSCKASGFTFRKYAMNWVRQAPGKGLEWVSAISGDGSSRSYADSVRGRFTISRDNSENTVYLQMNSLRAEDTAVYYCARTESNYDILTGYYWPSMDVWGKGTLVTVSSGGGGSGGGGSGGGGSSELTQDPAVSVALGQTVRITCQGDSLRSYYTNWFQQKPGQAPLLVVYAKNKRPSGIPDRFSGSSSGNTASLTITGAQAEDEADYYCHSRDSSGNHVLFGGGTKLTVLG

SEQ ID NO: 1345 - protein, 251 aa, Homo sapiens
KVQLVQSGAEVKKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGQGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1346 - protein, 251 aa, Homo sapiens
EVQLVQSGGGLVQPGGSLRLSCAASGFTFSDHYMDWVRQAPGKGLEWVGRARNKANSYTIEYAASVKGRFTISRDDSKNSLFLQMNSLKTEDTAVYYCARAPYDILTGYSDYYGMDVWGRGTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1347 - protein, 249 aa, Homo sapiens
GVQLVQSGAEVKKPGSSVKVSCKASGGNFNSYAISWVRQAPGQGPEWMGGFIPVFRTVQYSKKFQDRVTITADELTRTVYMELRSLRYDDTAMYYCARDSDARLAALDAFDIWGKGTLVTVSSGGGGSGGGGSGGGGSQSVLTQPPSASGTPGQRVTISCSGSSSNIGSNTVNWYQRLPGAAPQLLIYNNDQRPSGIPDRFSGSKSGTSGSLVISGLRSEDEADYYCASWDDSLNGRVFGGGTKLTVLG

SEQ ID NO: 1348 - protein, 250 aa, Homo sapiens
EVQLVQSGAEVKKTGSSVKLSCRASGYGFARHYLHWVRQAPGQALEWMGWVTPFNGNTDYAQKFQGRVTITADELTSTAFLDVSSLTSEDTAVYYCARGQFGVLPNYYYHMDVWGRGTMVTVSSGGGGSGGGGSGGGGSQSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLG

SEQ ID NO: 1349 - protein, 253 aa, Homo sapiens
EVQLVQSGAEVKKPGSSVKVSCKASGGTFSNYVISWVRQAPGQGLEWMGRITPILGTPNLAQKFQGRLTITADELTKTAYMELSRLRPEDTAIYYCARDIKRYNSNWPYYDYYMDVWGKGTLVTVSSGGGGSGGGGSGGGGSQSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLG

SEQ ID NO: 1350 - protein, 254 aa, Homo sapiens
EVQLVESGGGLVKPGGSLRLSCAASGLTFSSHWMSWVRQAPGKGLEWVANIKQDGSEEHYVDSVKGRFTISRDNAKNALYLQMDSLRAEDTAVYYCARDKQYYDILTGDPVEGGMDVWGKGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1351 - protein, 251 aa, Homo sapiens
EVQLVQSGAEVKKPGASVKVSCKASGYIFTDFAMHWVRQAPGQRLEWVGWINAGNGNTKYSQKFQDRVIITRDTSASTVYMELSSPGSEDTALYYCARATYDPLTGYSFDGFDIWGQGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTIFGLQAEDEADYYCSSYTTRSTRVFGGGTKLTVLG

SEQ ID NO: 1352 - protein, 247 aa, Homo sapiens
QVQLVESGAEVKKPGSSVKVSCKASGGTFGKYAFSWVRQAPGQGLEWMGGILPIFGTAKYAEKFEDRVTITADELTRTAYMELRRLRSEDTAVYYCARAGSSLVTYGTDVWGKGTMVTVSSGGGGSGGGGSGGGGSQSVLTQPPSVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1353 - protein, 253 aa, Homo sapiens
EVQLVQSGSELKKPGASVKVSCKASGYTFTRYPMNWVRQAPGQGLEWIGRINTNIGDPTYAQGFEGRFVFSLDTAVKTAYLQINSLKAEDTAVYYCARSDDYDILTGNYVGSLLDYWGRGTLVTVSSGGGGSGGGGSGGGGSQSVLTQPASVSGSSGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1354 - protein, 257 aa, Homo sapiens
EVQLVQSGAEVKKPGASVKVSCKASGYTFSNYGISWVRQAPGQGLEWMGWISAYNGNRNYAQKLQGRVTMTTDTSTSTAYMELRSLRSDDTAVYFCARDGRLSYDILTGYYARDYYGMDVWGRGTMVTVSNGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1355 - protein, 251 aa, Homo sapiens
QVQLQQSGAEVKKPGASVKVSCKTSGYTFTSYAIHWVRQAPGQSLEWMGWINTGNDNTKYSRKFQGRVTITKDTSASAAYMELSSLGSEDTALYYCARATYDPLTGYSFDGFDIWGQGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTALG

SEQ ID NO: 1356 - protein, 259 aa, Homo sapiens
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARDQNHPIYDILTGYYVPTGPLELKNWGRGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRGTRVFGGGAKLTVLG

SEQ ID NO: 1357 - protein, 251 aa, Homo sapiens
QVQLVESGGGVVQPGRSLRLSCATSGFTFSDYRMHWVRQAPAKGLEWVGSISEDGVNKYYADSVRGRFAISRDNSKSTLYLQLNSLRPEDTAVYYCATEVRNYDLLTRSYLAGPLDNWGQGTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSGGNHVVFGGGTKLTVLG

SEQ ID NO: 1358 - protein, 253 aa, Homo sapiens
EVQLVQSGAEVKKPGASVTVSCKASGYTLTNYYMHWVRQAPGQGPEWMGIINPNGGRTTYGQKFQGRVTMTSDTSTSTVYMQLSRLRSEDTAVYYCARDMGYDILTGYYGAFDIWGRGTMITVSSGGGGSGGGGSGGGGSAQSVLTQPPSVSGAPGQRVTISCTGSSSNIGTGYDVHWYQQLPGTAPKLLIYGYTNRPSGVPDRFSGSQSGTSASLAITGLQPEDEADYYCQSYDSGLRASVFGGGTKVTVLG

SEQ ID NO: 1359 - protein, 253 aa, Homo sapiens
QVQLVQSGAEVKTPGASVKVSCRASGYPFSSYHLHWVRQAPGQGLEWMGIINPNGGSTKYAQKFQGRVTMTSDTSTSTVYMELTSLRSEDTAMYYCARDYYDVLTGFSLDGMDVWGQGTLVTVSSGGGGSGGGGSGGGGSAQSVLTQPPSVSGAPGQRVTISCTGSSSNIGTGYHVHWYQQLPGTAPKLLIYGNTNRPSGVPDRFSGSKSGTSASLAITGLQAEDEADYYCQSYDSSLSTYVFGTGTKVTVLG

SEQ ID NO: 1360 - protein, 248 aa, Homo sapiens
QVQLQESGPGLVKPSETLSLSCTVSGGSIRSYYWSWIRQSPGRGLEWIGHIYHSGSTDYNPSLRSRVTMSIDTSKNQFSLNLTSVTAADTAVYYCARDHYDVLTGSYLQAFDVWGQGTLVTVSSGGGGSGGGGSGGGGSALDIQLTQSPSSLSASVGDRVTITCRASQSIGRYLNWYQQKPGRAPRLLIFVTSSLHSDVPSRFSGSGSGTDFSLTISNLQPEDFATYYCQQSYTDPTFGQGTRLEIKR

SEQ ID NO: 1361 - protein, 253 aa, Homo sapiens
QVQLQESGPGLVKPSETLSLTCSVSGDSISRAPYYWNWIRKTPGKGLEWIGYISNSRGTNYNPSLKSRVTISVDTSTNQFYLKVNSATAADTAVYYCARGRYDFLTGYLRNFDYWGRGTLVTVSSGGGGSGGGGSGGGGSAQSVLTQPPSVSGSLGQSVTISCTGSSSDIGRHNFVSWYQQHPGKAPKLLIYDVTKRPSGVPDRFSGSKSGNTASLTVSGLQADDEADYYCSSFLGSNNFDVFGTGTKLTVLG

SEQ ID NO: 1362 - protein, 252 aa, Homo sapiens
EVQLVESGGGLVKPGGSLRLSCAASGFTFNPYTMNWVRQAPGKGLEWVSSISSSSNYIYYADSVKGRFTISRDNAKNSLYLQMNSLRAEDTAVYYCARGHYDILTGYYFGFDYWGRGTLVTVSSGGGGSGGGGSGGGGSAQAVLTQPSSVSGAPGQRVTISCTGSSSNIGAGYDVHWYQHVPGTAPKLLIYAKTNRPSGVPDRFSGSTSGTSASLAITGLQAEDEADYYCQSSDSRLRGSVFGGGTKLTVLG

SEQ ID NO: 1363 - protein, 248 aa, Homo sapiens
QVQLVQSGAEVKKPGSSVKVSCTASGGSFSSNPFTWVRQAPGQGLEWVGGISPMSGRKTYAQKFQGRVTITADELTKTVYMELSNLRSEDTAVYYCARDMKVYYKYALDVWGRGTMVTVSSGGGGSGGGGSGGGGSAQSVVTQPPSASGPPGQRVTISCSGSSSNIGSNTVNWYQQLPGTAPKLLIYHNNQRPSGVPDRFSGSKSGTSASLAITGLQAEDEAEYYCQSYDNNLRGSVFGGGTKVTVLG

SEQ ID NO: 1364 - protein, 253 aa, Homo sapiens
QVQLVQSGGGLVQPGGSLRLSCAASGFTFSSYAMTWVRQAPGRGLEWVATISDSADRKYYADSVKGRFTISRGNSRNMLYLQMNSLRAEDTAVYYCARDLRYDILTGYHDAFDIWGRGTLVTVSSGGGGSGGGGSGGGGSAQSVVTQPPSASGSPGQSVTISCTGTSSDVGRYNYVSWYQQHPGKVPKLMIYDVNKRPSGVPDRFSGSKSGNTASLTVSGLQAEDEADYYCSSYAGSSTHVVFGGGTKVTVLG

SEQ ID NO: 1365 - protein, 258 aa, Homo sapiens
QVQLVQSGAEVKKPGSSVKVSCRASGGSFIDDSINWLRQAPGQGLEWVGGTIPLANRANYAQKFRDRVTITADELTATVFLELTSLRSDDTALYYCARSSPPKWYDALTGHSSYHSAMDVWGQGTMVTVSSGGGGSGGGGSGGGGSAQSALTQPASVSGSPGQSITISCIGTSSDIGAYNYVSWYQQHPGKAPKLMIYDVIRRPSGVSNRFSGSKSGNTASLTISGLQAEDDADYYCSSYTTSTTLVFGTGTKVTVLG

SEQ ID NO: 1366 - protein, 252 aa, Homo sapiens
EVQLVQSGTEVKKPGASVTLTCKASGYTFNNYYIHWVRQAPGQGLEWMGTSSPRGTNTNYAKKFQGRVTISADKLTNTAYMEVSSLRSDDTAIYYCARHRRARVVVPVPGAMDVWGQGTLVTVSSGGGGSGGGGSGGGGSAQSVLTQPPSVSGTPGQRVTISCSGSSSNVGTSTVNWYQQFPGTAPNLLIFKNSQRPSGVPERFSGSKSGTSASLAISGLQSEDEADYHCATWDDNLNAWVFGGGTKVTVLG

SEQ ID NO: 1367 - protein, 250 aa, Homo sapiens
GVQLVQSGPEVKKPGASVKVSCTASGYTFTSYGVSWVRQAPGQGLEWIGWISAHNGQTKYAEKFQGRVTMTRNTSISTAYMELSSLRSEDTAVYYCARDGSYDILTGYYIDNYMDVWGKGTMVTVSSGGGGSGGGGSGGGGSSELTQDPAVSVALGQTVRITCQGDSLRSYYTIWFQQKPGQAPLLVVYAKNKRPSGIPDRFSGSSSGNTASLTITGAQAEDEADYYCHSRDSSGNHVLFGGGTKLTVLG

SEQ ID NO: 1368 - protein, 253 aa, Homo sapiens
QVQLQQSGAEVKKPGSSVKVSCRLSAGTFTNRYAISWVRQAPGQGLEWVGGIMPFHRTTHYAQKFQGRVTITADELTSTAFMEMTSLRYEDTAVFYCARRSMIVVTTAPYDAFDLWGRGTMVTVSSGGGGSGGGGSGGGGSAQSVLTQPPSASGTPGQGVTISCSGSSSNIGSNTVNWYQQLPGTAPKLLIYSNNQRPSGVPDRFSGSKSGTSASLAISGLRSEDEADYYCAAWDDSLSGWLFGGGTKVTVLG

SEQ ID NO: 1369 - protein, 246 aa, Homo sapiens
QVQLVQSGAEVKKPGASVKVSCKVSGYRFLSYGISWVRQAPGQGLEWMGWISTDSGRTKQAQNFQGRVIMTTDTLTTTVFLEVRNLRSDDSAVYYCARDTVRSGGMDVWGQGTMVTVSSGGGGSGGGGSGGGGSAQSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGYVFGTGTKVTVLG

SEQ ID NO: 1370 - protein, 250 aa, Homo sapiens
GVQLVQSGPEVKKPGASVKVSCTASGYTFTSYGVSWVRQAPGQGLEWIGWISAHNGQTKYAEKFQDRVTMTRNTSISTAYMELSSLRSEDTAVYYCARDGSYDILTGYYIDNYMDVWGKGTMVTVSSGGGGSGGGGSGGGGSSELTQDPAVSVALGQTVRITCQGDSLRSYYTNWFQQKPGQAPLLVVYAKNKRPSGIPDRFSGSSSGNTASLTITGAQAEDEADYYCHSRDSSGNHVLFGGGTKLTVLG

SEQ ID NO: 1371 - protein, 244 aa, Homo sapiens
QVQLVQSGAEVKKPGASVKVSCQASGYTFREYGIIWARQAPGQGLEWMGWISGQNGKTNLAQRFQGRVTITTDTLTSTAFMELTNLRVDDTAMYYCAASGPGWFDPWGQGTLVTVSSGGGGSGGGGSGGGGSAQSALTQPASVSGSPGQSITISCTGTSSDVGGYNYVSWYQQHPGKAPKLMIFDVTSRPSGVSNRFSGSKSANTASLTISGLQDEDEADYYCTSYTSSDTYVFGTGTKLTVLG

SEQ ID NO: 1372 - protein, 244 aa, Homo sapiens
QVQLVQSGAEVKKPGASVKVSCQASGYTFREYGIIWARQAPGQGLEWMGWISGQNGKTNLAQRFQGRVTITTDTLTSTAFMELTNLRVDDTAMYYCAASGPGWFDPWGQGTLVTVSSGGGGSGGGGSGGGGSAQSALTQPASVSGSPGQSITISCTGTSSDVGGYNYVSWYQQHTGKAPKLMIFDVTSRPSGVSNRFSGSKSANTASLTISGLQDEDEADYYCTSYTSSDTYVFGTGTKLTVLG

SEQ ID NO: 1373 - protein, 251 aa, Homo sapiens
EVQLVQSGAEVKKPGSSVKVSCRASGGSFNHAISWVRQAPGRGLEWMGGILPMYGTANYAQKFQDRVTITADKLTNTVYMDLSRLRYEDTAVYYCARELGSSIVGATTGALDMWGRGTMVTVSSGGGGSGGGGSGGGGSAQAVVIQEPSFSVSPGGTVTITCGLTSGSVTTSYYPTWYQQAPGQAPRTLIYSTKIRSSGVPDRFSGSIIGNKAALTITGAQADDESDYYCLLYMGSGTRVFGGGTKLTVLG

SEQ ID NO: 1374 - protein, 251 aa, Homo sapiens
QVQLVQSGAEVKKPGSSVKVSCQASGGNFNSYGVSWVRQAPGQGLEWMGRIIPNVGTANYAQKFQGRVTITADKLTSTVYLEVRSLRSEDTAVYYCARGDYDILTGYPAECFQIWGRGTMVTVSSGGGGSGGGGSGGGGSALSSELTQDPAVSVALGQTVRITCQGDSLRNYYPSWYQQMPGQAPVLVIYGKNNRPSGIPDRFSGSSSGNTASLTITGAQAEDEADYYCNSRDSSGNHVVFGGGTKLTVLG

SEQ ID NO: 1375 - protein, 253 aa, Homo sapiens
EVQLVQSGAEVKKPGSPVRVSCKASGGTFTRYAISWVRQAPGQGLEWMGRIIPILGIANYAQKFQGRVTITADKLTSTVYMELSSLRSEDTAVYYCARDNYDILTGYSRRFDPWGQGTLVTVSSGGGGSGGGGSGGGGSALNFMLTQPHSVSESPGKTVTISCTRSSGNIASKYVQWYQQRPDSAPTTVIYENNRRPSGVPDRFSGSIDSSSNSASLTISGLKTEDEADYYCQSYDTSALYVFGAGTKLTVLG

SEQ ID NO: 1376 - protein, 252 aa, Homo sapiens
QVQLVQSGAEVKKPGSSVKVSCRASGGSFNHAISWVRQAPGRGLEWMGGILPMYGTANYAQKFQGRVTITADKLTNTVYMDLSRLRYEDTAVYYCARELGLSIVGATTGALDMWGQGTLVTVSSGGGGSGGGGSGGGGSALSYVLTQPPSVSKGLRQTATLTCTGNSNNVGNHGATWLQQHQGHPPKLLSYRDKNRPSGLSERFSPSRSGNTASLTISGLQPEDEADYYCSAWDSSLSAWVFGGGTKVTVLG

SEQ ID NO: 1377 - protein, 249 aa, Homo sapiens
QVQLVQSGAEVKKPGSSVKVSCRASGGSFNHAISWVRQAPGRGLEWMGGILPMYGTANYAQKFQGRVTITADKLTNTVYMDLSRLRYEDTAVYYCARELGLSIVGATTGALDMWGQGTMVTVSSGGGGSGGGGSGGGGSAQAVLTQPSSVSVAPGETARVTCGGNNIGSKSVHWYQQQPGQAPVVVIYYDSDRPSGIPERFSGSNSGNTATLTISRVEAGDEADYYCQVWDSSSDLYVFGAGTKVTVLG

SEQ ID NO: 1378 - protein, 252 aa, Homo sapiens
QVQLVESGAEVKKPGSSVKVSCRASGGSFNHAISWVRQAPGRGLEWMGGILPMYGTANYAQKFQGRVTITADKLTNTVYMDLSRLRYEDTAVYYCARELGLSIVGATTGALDMWGRGTLVTVSSGGGGSGGGGSGGGGSAQAVLTQPSSVSGAPGQGVTISCTGSNSNIGTTYDVHWYQQLPGTAPKLLIYANTNRPSGVPDRFSGSKSGTSASLAITGLQAEDEADYYCQSYDNSLSAWVFGGGTKLTVLS

SEQ ID NO: 1379 - protein, 253 aa, Homo sapiens
  Site (239): Xaa equals any of the naturally occurring L-amino acids
QVQQSGAEVKKPGGSLRLSCAASGFTFSSYSMNWVRQAPGKGLEWVSSISSSSSYIYYADSVKGRFTISRDNAKNSLYLQMNSLRAEDTAVYYCAREGGNYDILTGYYIGNGAFDIWGRGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRXTRVFGGGTKLTVLG

SEQ ID NO: 1380 - protein, 251 aa, Homo sapiens
QVQLQQSGAEVKKPGASVKVSCKASKYTFANHYIHWVRQAPGEGLEWMGNINPSGSSTYYAQRFQGRVTMTRDTSTSTVYMELSNLRSDDTAVYYCARATYDPLTGYSFDGFDIWGKGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1381 - protein, 248 aa, Homo sapiens
QVQLQQSGAEVRKPGSSVKVSCKASGYTITNYFMHWVRQAPGQGLEWMGWINPNSGNTNYAQKFQGRVTMTRDTSISTTYMELSRLRSDDSAVYYCASTYYDILTGYHFDYWGKGTLVTVSSGGGGSGGGGSGGGGSQSVLTQPASVSGSPGQSITISCTGTSSNVGGYNYVSWYQQQAGKAPKLMIYEGSKRPSGVSNRFSGSKSGNTASLTISGLQAEDEADYYCSSYTTRSTRVFGGGTKLTVLG

SEQ ID NO: 1382 - protein, 247 aa, Homo sapiens
GVQLVQSGGGLVQPGGSLRLSCAASGFTFSDHYMDWVRQAPGKGLEWVGRTRNKANSYTTEYAASVKGRFTISRDDLTNLLFLQLNGLKTEDTAIYYCARGPGVIGNYDYWGQGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1383 - protein, 251 aa, Homo sapiens
QVQLQQSGAEVKKPGAAVILSCKASGYTFSRYTIHWVRQAPGQGPEWMGWINGGSGDTKYSRKFQGRVTITKDTSASAAYMELSSLGSEDTALYYCARATYDPLTGYSFDGFDIWGKGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRNTRVFGGGTKLTVLG

SEQ ID NO: 1384 - protein, 247 aa, Homo sapiens
GVQLVQSGAEVKKPGASVKVSCRASGYTFSSYYVHWVRQAPGQGLEWMGVINHSGDMAIYAQNFQGRVSMTRDLLTKTIYMELSSLRSDDSAVYFCARAVLRYSAGLQGAFDIWGKGTLVTVSSGGGGSGGGGSGGGGSSELTQDPAVSVALGQTVRITCQGDSLRSYYASWYQQKPGQAPVLVIYGKNNRPSGIPDRFSGSSSGNTVSLTITGAQAEDEADYYCNSRDSSGNHVVFGGGTKLTVLG

SEQ ID NO: 1385 - protein, 248 aa, Homo sapiens
EVQLVQSGAEVKKPGSSVKVSCQTSGTTFRHSAITWVRQAPGQGFEWLGHIIPVFETAHLSDKFQGRVTITADELTTTVYMELSSLRFEDTAVYYCARVSGYNSGYFESYDMDVWGQGTLVTVSSGGGGSGGGGSGGGGSDIVMTQSPSTLSASVGDRVTITCRASQGISSWLAWYQQKPGRAPKVLIYKASTLESGVPSRFSGSGSGTDFTLTISSLQPEDFATYYCQQSYSTPWTFGQGTKLEIKR

SEQ ID NO: 1386 - protein, 248 aa, Homo sapiens
EVQLVQSGAEVVKPGASVKVSCKASGYTFTGYYLHWVRQAPGQGLEWMGWINPSSGGTKYAQKFQGRLTITADELTKTVFMDLSRLTSEDTAVYYCATLNLEKTVVRGFGYFDLWGKGTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1387 - protein, 248 aa, Homo sapiens
QVQLQQSGAEVKKPGSSVKVSCKASGGTFNSYAISWVRQAPGEGLEWMGYINPNNGGTTYVEKFQGRVTMTRDTSISTAYMELNSLRSEDTAVYYCARDHYDILTGLYYYGMDVWGRGTLVTVSSGGGGSGGGGSGGGGSSELTQDPAVSVALGQTVRITCQGDSLRSYYTNWFQQKPGQAPLLVVYAKNKRPSGIPDRFSGSSSGNTASLTITGAQAEDEADYYCNSRDSSVNHVLFGGGTKLTVLG

SEQ ID NO: 1388 - protein, 248 aa, Homo sapiens
EVQLVQSGAEVVKPGASVKVSCKASGYTFTGYYLHWVRQAPGQGLEWMGWINPSSGGTKYAQKFQGRLTITADELTKTVFMDLSRLTSEDTAVYYCATLNLEKTVVRGFGYFDLWGKGTLVTVSSGGGGSGGGGSGGGGSSELTQDPAVSVALGQTVRITCQGVSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1389 - protein, 251 aa, Homo sapiens
QVQLQQSGAEVRKPGASVKVSCQASGYTFTDYHIHWVRQAPGQGLEWMGRINPNSGGTGYAQQFQGRVTLTRDTSTSRVYMELNSLRSEDTAMYYCARGGELVWFGESDYYGMDVWGRGTMVTVSSGGGGSGGGGSGGGGSSELTQDPAVSVTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLG

SEQ ID NO: 1390 - protein, 251 aa, Homo sapiens
QVQLQQSGTEARNPGASVRLSCKTSGYSFINYAIHWVRQAPGQGLEWVAWIHPGNGKTKYSPRFQGRVTITKDTSASAAYMELSSLGSEDTALYYCARATYDPLTGYSFDGFDIWGKGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1391 - protein, 240 aa, Homo sapiens
QVQLVESGGGLVRPGGSLRLSCAASGSSFDTYTMTWVRQVPGKGLEWLSSITSGSRFVYYADSLKGRITISRDNARNSLTLQVSSLRAEDTAVYYCARSQRLFIDSWGRGTMVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1392 - protein, 256 aa, Homo sapiens
QVQLVQSGGGLVQPGGSLRLSCAASGFTFSNYDMSWVRQAPGKGLEWVSGISGSGGSKYYADSVKGRFTISRDNSKNSLYLQVNSLRAEDTAVYYCAKDRYYDILTGYYIPGLDDAFDIWGQGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1393 - protein, 246 aa, Homo sapiens
GVQLVQSGAEVKKPGSSVKVSCKASGGNFNSYAISWVRQAPGQGPEWMGGFIPVFRTVQYSKKFQDRVTITADELTRTVYMELRSLRYDDTAMYYCARDSDARLAALDAFDIWGRGTMVTVSSGGGGSGGGGSGGGGSSELTQDPAVSVALGQTVRITCQGDSLRSHYTNWFQQKPGQAPLLVVYAKNKRPSGIPDRFSGSSSGNTASLTITGAQAEDEADYYCHSRDSSGNHVLFGGGTKLTVLG

SEQ ID NO: 1394 - protein, 252 aa, Homo sapiens
EVQLVQSGGGVVQPGRSLRLSCAASGFTFSSYGMHWVRQAPGKGLEWVAVISYDGSNKYYADSVKGRFTISRDNSKNTLYLQMNSLRAEDTAVYYCAKEESYYDILTGYYVHYYGMDVWGKGTLVTVSSGGGGSGGGGSGGGGSSELTQDPAVSVALGQTVRITCQGDSLRSYYTNWFQQKPGQAPLLVVYAKNKRPSGIPDRFSGSSSGNTASLTITGAQAEDEADYYCHSRDSRGNHVLFGGGTKLTVLG

SEQ ID NO: 1395 - protein, 251 aa, Homo sapiens
EVQLVQSGAEVRKPGASVKVSCTTSGYIFSKYTIHWVRQAPGQGPEWMGWINGGSGGTKYSRNFQGRLTISKDTSASVVYMELSSLGSEDTALYYCARATYDPLTGYYFDGFDIWGQGTMVTVSSGGGGSGGGGSGGGGSQSVLTQPASVSGSPGQSLTISCTGTSSDVGGYNYVSWYQQHPGKAPKLMIYEGSKRPSGVSNRFSGCKSGNTASLTISGLQAEDEADYYCSSYTTRSHVVFGGGTKLTVLG

SEQ ID NO: 1396 - protein, 251 aa, Homo sapiens
QVQLQQSGAEVKKPGASVKVSCKASGYTFTSYAIHWVRQAPGQGPEWMGWINGGSGDTKYSRKFQGRVTITKDTSASAAYMELSSLGSEDTALYYCARATYDPLTGYSFDGFDIWGQGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1397 - protein, 251 aa, Homo sapiens
QVQLQQSGAEVKKPGSSVKVSCKASGGTFSSYAISWVRQAPGQGLEWMGRIIPIPGIANYAQKFQGRVTITADKSTSTAYMELSSLRSEDTAVYYCATAYYDILTGFLPYDMDLWGQGTTVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1398 - protein, 254 aa, Homo sapiens
QVQLQQWGGGVVQPGRSLRLSCEASGFTFSSYGMHWVRQAPGKGLEWVAVISYDERIKNYGDSVKGRFTGSRDNSKNTLYLEMNSLRPEDTAVYYCATEVRNYDLLTRSYLAGPLDNWGQGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGDTASLTISGLQAEDEADYYCSSYTTRSTRVFGGGTKLTVLG

SEQ ID NO: 1399 - protein, 253 aa, Homo sapiens
GVQLVESGGGLVQSGGSLRLSCSASGFSVSSNHMNWVRQAPGKGLEWVSVTYSGGNTNYADSVRGRFTISRDNSKNTLYLQMNSLRAEDTAVYYCAREGSYDILTGYYVGVGRMDVWGRGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1400 - protein, 247 aa, Homo sapiens
QVTLKESGGGLVKPGRSLRLSCTASGFTFGDYAMSWFRQAPGKGLEWVGFIRSKAYGGTSEYAASVKGRFTISRDDSTNTLYLQMTRLRAEDSAVYYCVRRDILTGFYDSWGRGTTVTVSSGGGGSGGGGSGGGGSQSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLG

SEQ ID NO: 1401 - protein, 252 aa, Homo sapiens
QVQLQQSGPGLVKPSETLSLTCTVSGDSIRRSPYYWGWVRQSPGKGLEWIGTVYYSGHTYYNPSLKSRVTMSVDTFMNQFSLRLASVTAADTAVYYCARATYDPLTGYSFDGFDIWGQGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1402 - protein, 249 aa, Homo sapiens
QVQLVQSGGGLVQPGRSLRLSCTASGFTFGDYAMSWFRQAPGKGLEWVGFIRSKAYGGTTEYAASVKGRFTISRDDSKSIAYLQMNSLRAEDTAVYYCARDFYDILTGYQHGMDVWGKGTLVTVSSGGGGSGGGGSGGGGSSELTQDPAVSVALGQTVRITCQGDSLRSYYTNWFQQKPGQAPLLVVYAKNKRPSGIPDRFSGSSSGNTASLTITGAQAEDEADYYCHSRDSSGNHVLFGGGTKLTVLG

SEQ ID NO: 1403 - protein, 248 aa, Homo sapiens
EVQLVQSGPEVKKPGSSVKVFCKASGGTFNTYGISWVRQAPGQGLEWMGGLIPKFGTPKYAQKFQGRLTITADTLTGTAYMELSSLRSDDTAVYFCARHSKEYNWNYALDYWGRGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1404 - protein, 248 aa, Homo sapiens
GVQLVQSGGGLVQPGGSLRLSCAASGFTFSIYAMSWVRQAPGKGLEWVSAISHNADHTYSADSVKGRFTISRDNSKNTLYLQMNSLRAEDTAIYYCAATRMDVLTRYYSDFWGQGTLVTVSSGGGGSGGGGSGGGGSQSVLTQPASVSGSPGQSIAISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1405 - protein, 254 aa, Homo sapiens
EVQLVQSGAEVKKPGSSVKVSCKASGYTFTSYGISWVRQAPGQGLEWMGWISAYNGNTNYAQKLQGRVTMTTDTSMSTAYMELRSLRSDDTAVYYCARAFEDYDILTGYYHHDAFDIWGKGTTVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1406 - protein, 243 aa, Homo sapiens
QVQLQQSGAEVKKPGASVKVSCRASGYTFSSYYVHWVRQAPGQGLEWMGVINHSGDMAIYAQNFQGRVSMTRDLLTKTIYMELSSLRSDDSAVYYCAAPSYHYMDVWGRGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1407 - protein, 255 aa, Homo sapiens
QVQLVQSGAEVKKPGASVKVSCKASGYTFTDYYLHWVRQAPGQGLEWMGWINPNSGGTNYAQMFQGRVTMTRDTSISTASMELSRLRSDDTAVYYCARVNADYDILTGYPRDYYGMDVWGKGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1408 - protein, 251 aa, Homo sapiens
QVQLQQSGAEVRKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGQGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1409 - protein, 256 aa, Homo sapiens
QVQLQQSGAEENKPVTSGKVSCKATGGTFSSYAISWPRQAPGHGLEWMEGIIPIFGTAYYAQKFQSRDSITADESTSTDYMELTSLRSEDTAVYYCAREDATYYDILTGYYMGSYGMDVWGKGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDGADYYCSSYTTRSTRVFGGGTKLTVLG

SEQ ID NO: 1410 - protein, 250 aa, Homo sapiens
GVQLVQSGAEVKQPGSSVNVSCKVSGGTFGSSGITWVRQAPGEGLEWMGRIIPVLGTTNYAQRFQGRVTIIADELTNTVNMELSGLRSEDTATYYCARETRKYTSSPPYNYYYMDVWGQGTLVTVSSGGGGSGGGGSGGGGSDIVMTQSPSTLSASVGDRVTITCRASQGISSWLAWYQQKPGRAPKVLIYKASTLESGVPSRFSGSGSGTDFTLTISSLQPEDFATYYCQQSYSTPWTFGQGTKLEIKR

SEQ ID NO: 1411 - protein, 251 aa, Homo sapiens
EVQLVQSGGGVVQLGRSLRLSCAASGFTFSSYAMHWVRQAPGKGLEWVALISSDGSHKYYADSVKGRFTVSRVNSENTLFLQMNSLRAEDTAVYYCARRDYDILTGYSRGFDPWGKGTLVTVSSGGGGSGGGGSGGGGSSYVLTQPPSVSGTPGQRVTISCSGGRSNIGSNTVKWYQQLPGTASKLLIYGNDQRPSGVPDRFSGSKSGTSASLAITGVQAEDEADYYCQSYDSSLRGSRVFGTGTKVTVLG

SEQ ID NO: 1412 - protein, 254 aa, Homo sapiens
QVQLQQSGAEVKKPGSSVKVSCKASGGTFSSYAISWVRRAPGQGLEWMGGIIPIFGTANYAQKFQGRVTITADESTSTAYMELRSLRSDDTAVYYCARDGIYDILTTLVSYYNGMDVWGKGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAKDEADYYCSSYTTRSTRVFGGGTKLTVLG

SEQ ID NO: 1413 - protein, 250 aa, Homo sapiens
QAQLQQWGAGLLKPSETLSLTCLVDGGPFSGYYWSWIRQPPGKGLEWIGEINHSGSTNYNPSLKSRVTISVDTSKNQFSLKLSSVTAADTAVYYCARGERDILTGYYLDGMDVWGRGTMVTVSSGGGGSGGGGSGGGGSQSVLTQPPSVSAAPGQKVTISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1414 - protein, 250 aa, Homo sapiens
EVQLVQSGAEVKKPGSSVKVSCKASGGTFSSYVISWVRQAPGQGLEWMGGIIPMSGTANYAQKFQGRVTITADELTKTAYMELSRLRSEDTAVYYCAKERGSYSSGYSGAFDVWGRGTLVTVSSGGGGSGGGGSGGGGSQSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLG

SEQ ID NO: 1415 - protein, 252 aa, Homo sapiens
QVQLVQSGAEVKKPGSSVKVSCKASGGTFSSYGISWVRQAPGQGLEWMGGIIPILGTVNYAQKFLGRVTITADELTNIVNMELSSLRSEDTAVYFCARESGGYSYGSRDYYGMDVWGKGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1416 - protein, 252 aa, Homo sapiens
EVQLVESGGGLVQPGRSLRLSCAASGFTFDEYAMHWVRQAPGKGLEWVSGISWNSGSIAYADSVKGRFTISRDNAKNSLYLQMNSLRAEDTALYYCAKDRGVGYDILTGRTYYYGMDVWGQRTMVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCDSRDSSGNHVVFGGGTKLTVLG

SEQ ID NO: 1417 - protein, 248 aa, Homo sapiens
EVQLVQSGAEVKKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGQGTMVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSGGNHVVFGGGTKLTVLG

SEQ ID NO: 1418 - protein, 253 aa, Homo sapiens
QVQLVQSGAEENKPGDSVRVSCKASGYTFTSHYMHWVRQAPGQGLEWMGVINPTGSATNYAQKFQDRVTMTRDTSTSTDYMELSSLRSEDTAVYYCARDVSGHDILTGYSYRYFDVWGRGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1419 - protein, 249 aa, Homo sapiens
QVTLKESGAEVKKPGSSVKVSCKASGGTFSSYGISWVRQAPGQGLEWMGVIIPMIGTPHYAPKFQGRVTITADELTNTVNLDLSSLSSEDTAVYYCARGQKNYYESSGYLEHWGQGTLVTISSGGGGSGGGGSGGGGSQSVLTQPPSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLG

SEQ ID NO: 1420 - protein, 250 aa, Homo sapiens
QVQLVQSGGGLVQPGRSLRLSCAASGFTFSSYAMSWVRQAPGKGLEWVSAISGSGGSTYYADSVKGRFTISRDNSKNTLYLQMNSLRAEDTAVYYCARGDYDILTGYYSHFDYWGRGTLVTVSSGGGGSGGGGSGGGGSQSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLG

SEQ ID NO: 1421 - protein, 248 aa, Homo sapiens
EVQLVESGGGLVQPGGSLRLSCAASGFTFSSYAMHWVRQAPGKGLEWVAVISYDGSNKYYADSVKGRFTISRDNSKNTLYLQMNSLRAEDTAVYYCARAYDYDILTGYSYYFDYWGKGTLVTVSSGGGGSGGGGSGGGGSDIQMTQSPSTMSASIGDRVTITCRASEGIYHWLAWYQQKPGKAPKLLIYKASSLASGAPSRFSGSGSGTDFTLTISSLQPDDFATYYCQQYSNYPLTFGGGTKLEIKR

SEQ ID NO: 1422 - protein, 245 aa, Homo sapiens
QVQLQQSGAEVKKPGSSVKVSCKASGGTFSNYAFSWVRQAPGQGLEWMGGIIPIFGTANYAQKLQGRVTITADELTRTVYMDLSSLRSEDTAVYYCATGMGDHYGMDVWGKGTLVTVSSGGGGSGGGGSGGGGSQSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLG

SEQ ID NO: 1423 - protein, 247 aa, Homo sapiens
QVQLLQSAAEVKKPGSSVKVSCKASGGTFSSYAISWVRQAPGQGLEWMGGILPIFGTAKYAEKFEDRVTITADELTRTAYMELRRLRSEDTAVYYCARAGSSLMTYGTDVWGKGTTVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLD

SEQ ID NO: 1424 - protein, 242 aa, Homo sapiens
RVQLQQSGAEVKKPGSSVKVSCKASGGTFSNYAFSWVRQAPGQGLEWMGGIIPIFGTANYAQKLQGRVTITADELTRTVYMDLSSLRSEDTAVYYCATGMGDHYGMDVWGQGTLVTVSSGGGGSGGGGSGGGGSSELTQDPAVSVALGQTVRITCQGDSLRSYYASWYQQKPGQAPVLVIYGKNNRPSGIPDRFSGSSTGNTASLTITGAQAEDEADYYCNSRDSSGNHVVFGGGTKLTVLG

SEQ ID NO: 1425 - protein, 249 aa, Homo sapiens
QVQLVESGAEVKKPGASVKVSCKASGYTFTSYGISWVRQAPGQGLEWMGWISAYNGNTNYAQKLQGRVTMTTDTSTSTAYMELRSLRSDDTAVYYCARGGNYDILTGYYIGAFDIWGQGTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1426 - protein, 246 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHYGMDVWGRGTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1427 - protein, 254 aa, Homo sapiens
EAQLVQSGGGLVQPGRSLRLSCAASGFTFDDYAMHWVRQAPGKGLEWVSGISWNSGSIGYADSVKGRFTISRDNSKNTLYLQMNSLRAEDTAVYYCTRGYEYYDILTGYNELGAFDIWGRGTLVTVPSGGGGSGGGGSGGGGSQSVLAQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1428 - protein, 254 aa, Homo sapiens
EVQLVESGGGVVQPGRSLRLSCAASGFTFSTYGMHWVRQAPGKGLEWLSVISKDGNKKYYADSVKGRFTISRDNSKNTLYLQMNSLRAEDTAVYYCAKDGTYYDILTGYYNQYGMDVWGRGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1429 - protein, 247 aa, Homo sapiens
QVQLVQSGAEVKKPGSSVKVSCKASGDTFSSYAISWVRQAPGQGLEWMGGILPIFGTAKYAEKFEDRVTITADELTRTAYMELRRLRSEDTAVYYCARAGSSLMTYGTDVWGQGTLVTVSSGGGGSGGGGSGGGGSQSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLG

SEQ ID NO: 1430 - protein, 245 aa, Homo sapiens
QVQLQQSGAEVKKPGSSVKVSCKASGGTFSNYAFSWVRQAPGQGLEWMGGIIPIFGTANYAQKLQGRVTITADELTRTVYMDLSSLRSEDTAVYYCATGMGDHYGMDVWGRGTLVTVSSGGGGSGGGGSGGGGSQSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLG

SEQ ID NO: 1431 - protein, 252 aa, Homo sapiens
QVQLVQSGGGLVKPGGSLRLSCAASGFTLSSSSMNWVRQAPGKGLEWVSAISGSGGSTYYADSVKGRFTISRDNSKNTLYLQMNSLRAEDTAVYYCTKDRGYDILTGYYYYGMDVWGRGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1432 - protein, 253 aa, Homo sapiens
QVQLLQSAGGVVRPGGSQRLSCSASGFTFSDYGIHWVRQGPGKGLEWVAFITSNGSNKYYGDTVKGRFTISRDNSRNMVYLQMNSLSAEDTAVYYCAREVRDYDILTGYYISYMDVWGRGTTVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1433 - protein, 242 aa, Homo sapiens
QVQLQQSGAEVKKPGSSVKVSCKASGGTFSNYAFSWVRQAPGQGLEWMGGIIPIFGTANYAQKLQGRVTITADELTRTVYMDLSSLRSEDTAVYYCATGMGDHYGMDVWGQGTMVTVSSGGGGSGGGGSGGGGSSELTQDPAVSVALGQTVRITCQGDSLRSYYASWYQQKPGQAPVLVIYGKNKRPSGIPDRFSGSSSGNTASLTITGAQAEDEADYYCHSRDSSGNHVLFGRGTKLTVLG

SEQ ID NO: 1434 - protein, 247 aa, Homo sapiens
EVQLVQSGAEVKKPGSSVKVSCKASGDTFSSYAISWVRQAPGQGLEWMGGILPIFGTAKYAEKFEDRVTITADELTRTAYMELRRLRSEDTAVYYCARAGSSLMTYGTDVWGQGTTVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1435 - protein, 252 aa, Homo sapiens
GVQLVQSGAEVKKPGASVKVSCRASNYTFTNYGISWVRQAPGQGLQWLGRIIPILGTSNFAQKFQDRLTMSADELTSTVYMELDSLTSEDTAIYYCARGLYFEDTNYRHGDAFDIWGQGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1436 - protein, 245 aa, Homo sapiens
QVQLQQSGAEVKKPGSSVKVSCKASGGTFGNYAFSWVRQAPGQGLEWMGGIIPIFGTANYAQKLQGRVTITADELTRTVYMDLSSLRSEDTAVYYCATGMGDHYGMDVWGQGTLVTVSSGGGGSGGGGSGGGGSQSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLG

SEQ ID NO: 1437 - protein, 251 aa, Homo sapiens
QVQLQQSGAEVKKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGQGTMVTVSSGGGGSGGGGSGGGGSQSVLTQPASVSGSPGQSITISCTGTSSDVGGYNYVSWYQQHPGKAPKLMIYEGSKWPSGVSNRFSGSKSGNTASLTISGLQAEDEADYYCSSYTTRSTRVFGGGTKLTVLG

SEQ ID NO: 1438 - protein, 242 aa, Homo sapiens
GVQLQQSGAEVKKPGSSVKVSCKASGGTFGSSPITWVRQAPGQGLEWMGDIVPIFGTANYAQKLQGRVTITADELTRTVYMDLSSLRSEDTAVYYCATGMGDHYGMDVWGKGTMVTVSSGGGGSGGGGSGGGGSSELTQDPAVSVALGQTVRITCQGDSLRSYYTNWFQQKPGQAPLLVVYAKNKRPSGIPDRFSGSSSGNTASLTITGAQAEDEADYYCHSRDSSGNHVLFGGGTKLTVLG

SEQ ID NO: 1439 - protein, 250 aa, Homo sapiens
QVQLQQSGAEVKKPGSSVKVSCKASGGTFSSYAISWVRQAPGQGLEWMGRIIPIVNMANYAQKFQGRVTLTADKSTGTAYMELTSLRSEDTAVYYCARENYDFLTGYYGAFDIWGKGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1440 - protein, 248 aa, Homo sapiens
GVQLVESGAEVKKPGSSVKVFCKASGGTFNTYGISWVRQAPGQGLEWMGGLIPKFGTPKYAQNFQDRLTITADTLTGTAYMELSSLSSDDTAVYYCARHSKEYNWNYALDYWGRGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1441 - protein, 254 aa, Homo sapiens
EVQLVQSGGDLVKPGGSLRLSCTASGFPFDDYDMNWIRQAPGKGLEWLSYITVRGTSVYYADSVKGRFTISRDNAKNSLYLEMKSLRDEDTAVYYCARERSQFDFLTGVDRYHPMDVWGRGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1442 - protein, 249 aa, Homo sapiens
QVQLVQSGAEVKKPGSSVKVSCKASGGTFKYYTFSWIRQAPGHWLEWMGGINPIRGTANYAQKSRGGVTITADELTNTVYMELTSLESDDTAVYFCAAEGAADYLNGQYFQHWGQGTLVTVSSGGGGSGGGGSGGGGSQSVLTQPASVSGSPGQSITISCTGTSSDVGGYNYVSWYQQHSGKAPKLMIYEGSKRPSGVSNRFSGSKSGNTASLTISGLQAEDEADYYCSSYTTRSTRVFGGGTKLTVLG

SEQ ID NO: 1443 - protein, 247 aa, Homo sapiens
QVQLLQSAAEVKKPGSSVKVSCKASGGTFSSYAISWVRQAPGQGLEWMGGIIPIFGTAKYAEKFEDRVTITADELTRTAYMELRRLRSEDTAVYYCARAGSSLMTYGTDVWGRGTMVTVSSGGGGSGGGGSGGGGSQSVLTQPPSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLG

SEQ ID NO: 1444 - protein, 242 aa, Homo sapiens
QVQLQQSGAEVKKPGSSVKVSCKASGGTFSNYAFSWVRQAPGQGLEWMGGIIPIFGTANYAQKLQGRVTITADELTRTVYMDLSSLRSEDTAVYYCATGMGDHYGMDVWGQGTMVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1445 - protein, 249 aa, Homo sapiens
QVQLQQSGAKVKRPGSSVKVSCRPSGATFSGYALSWVRQAPGQGLEWLGRIIPILGTSNFAQKFQDRLTMSADELTSTVYMELDSLTSEDTAIYYCARGLYFEDTNYRHGDAFDIWGQGTMVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1446 - protein, 248 aa, Homo sapiens
QVQLQQSGAVVKKPGASVKVSCKASGYTFTSYGISWVRQAPGQGLEWMGWISAYNGNTNYAQKLQGRVTMATDTSTSTAYMELRSLRSDDTAVYYCARVYYDILTGHPTYGMDVWGQGTLVTVSSGGGGSGGGGSGGGGSDIQMTQSPSFLSASVGDRVTITCRASQGINNYLAWYQQKPGRAPKLLIYAASSLQSGVPSRFSGSGSGTDFTLTISSLQPEDFATYYCLQDSDYPLTFGGGTKLEIKR

SEQ ID NO: 1447 - protein, 254 aa, Homo sapiens
QVQLVQSGGGLVKPGGSLRLSCAASGFTFSNAWMSWVRQAPGKGLEWVGRIKSKTDGGTTDYAAPVKGGFTISRDDSKNTLYLQMNSLKTEDTAVYYCTTGIYDILTGYHWDDAFDIWGRGTMVTVSSGGGGSGGGGSGGGGSQSVLTQPPSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLG

SEQ ID NO: 1448 - protein, 254 aa, Homo sapiens
QVQLVQSGAEVKKPGSSVKVSCKASGGTFSSSAISWVRQAPGHGLEWMGGIIPIYGTANYAQRFQGRVTITADKSTSTAYMELSSLRSEDTAVYYCARESTYDILTGSYHDYGLDVWGKGTLVTVSSGGGGSGGGGSGGGGSSYVLTQPPSVSGTPGQRVTISCSGGRSNIGSNTVKWYQQLPGTAPKLLIYGNDQRPSGVPDRFSGSKSGTSASLAITGVQAEDEADYYCQSYDSSLRGSRVFGTGTKVTVLG

SEQ ID NO: 1449 - protein, 253 aa, Homo sapiens
EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCARDRLHYDILTGHQTDDAFDIWGQGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTARSTRVFGGGTKLTVLG

SEQ ID NO: 1450 - protein, 254 aa, Homo sapiens
KVQLVQSGAEVKKPGSSVKVSCQASGGTFSNFAISWVRQAPGQGLEWMGGFIPVFGTPNYAQKFQGRVTMTADEFTSTAYMELSSLRSEDTAVYYCARVLTNYDILTGYYREDAFDMWGQGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1451 - protein, 245 aa, Homo sapiens
QVQLQQSGAEVKKPGASVKVSCKASGYTFTSYYMHWVRQAPGQGLEWMGVINPSGDGTSYAQKFQGRVTITADELTRTVYMDLSSLRSEDTAVYYCATGMGDHYGMDVWGQGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1452 - protein, 259 aa, Homo sapiens
QMQLVQSGAEVKKPGASVKVSCKASGYTFTNYGISWVRQAPGQGLEWMGWISTYNGDTNYAQKLQGRVTMTTDTSTSTAYMELRSLRSDDTAVYYCARDRGASNYDILTGYYAPAQGVAFDIWGRGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1453 - protein, 258 aa, Homo sapiens
QVQLQESGPGLVKPSQTLSLTCAISGDSVSSDSVAWNWIRQSPSRGLEWLGRTYYRSKWHTDYAVSLKSRMTINPDTSRNQFSLQLNSVTPEDTAVYYCAREGAHYDILTGHNYYHYGMDVWGKGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1454 - protein, 253 aa, Homo sapiens
GVQLVQSGAEVKQPGSSVNVSCKVSGGTFGSSGITWVRQAPGEGLEWMGRIIPVLGTTNYAQRFQGRVTIIADELTNTVNMELSGLRSEDTATYYCARETRKYTSSPPYNYYYMDVWGRGTMVTVSSGGGGSGGGGSGGGGSQSVLTQPASVSGSPGRSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1455 - protein, 247 aa, Homo sapiens
QVQLVQSGAEVKKPGSSVKVSCKATGGIFSSYAMYWVRQAPGQGLEWMGGITPILGTTHYAPEFEDRVTITADELTRTAYMELRRLRSEDTAVYYCARAGSSLMTYGTDVWGKGTLVTVSSGGGGSGGGGSGGGGSSYVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLG

SEQ ID NO: 1456 - protein, 248 aa, Homo sapiens
QVQLVQSGGGVVQPGGSLRLSCAASGFTFSSYAMSWVRQAPGKGLEWVSAISGSGGSTYYADSVKGRFTISRDNSKNTLYLQMNSLRAEDTAVYYCARDQHDILTGVYYGMDVWGKGTMVTVSSGGGGSGGGGSGGGGSALSSELTQDPAVSVALGQTVRITCQGDGLRNYYANWYQQKPGQAPVLVIYGKNNRPSGIPVRFSGSSSGNTASLTITGARAEDEGVYYCNYRDSSGAVFGGGTKLTVLG

SEQ ID NO: 1457 - protein, 245 aa, Homo sapiens
QVQLQQSGAEVKKPGSSVKVSCKASGGTFSNYAFSWVRQAPGQGLEWMGGIIPIFGTANYAQKLQGRVTITADELTRTVYMDLSSLRSEDTAVYYCATGMGDHYGMDVWGRGTLVTVSSGGGGSGGGGSGGGGSQSVLTQPPSASGTPGQRVAISCSGSSYNIGSNTVNWYQRLPGAAPQLLIYNNDQRPSGIPDRFSGSKSGTSGSLVISGLQSEDEADYYCASWDDSLNGRVFGGGTKLTVLG

SEQ ID NO: 1458 - protein, 260 aa, Homo sapiens
QVQLVQSGGGVVQPGRSLRLSCAASGFTFRSYAMSWVRQAPGKGLEWVSGISGNAGSNKYYADSVKGRFTISRDNSKNTLYLQMNSLRAEDTAVYYCARDYPGSEYDILTGYLFGYYYYGMDVWGQGTMVTVSSGGGGSGGGGSGGGGSQSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLG

SEQ ID NO: 1459 - protein, 251 aa, Homo sapiens
QVQLQQSGAEVKKPGASVKVSCKASGYTFTTYYMHWVRQAPGQGLEWMGIINPSGGSTNYAQKFQGRVTMTRDTSTGTVYMELSSLRSEDTALYYCARATYDPLTGYSFDGFDIWGQGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1460 - protein, 250 aa, Homo sapiens
QVQLQQSGAEVKEPGSSVTVSCKTSGGTFRTAGISWVRQAPGQGLEWIGGIIPILGPPNYAQILKGRLTITADELTNTAYMELSSLRSDDTAVYYCATARRVGVLGGKNAFEIWGRGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTELTVLG

SEQ ID NO: 1461 - protein, 250 aa, Homo sapiens
QVQLVQTGGGVVQPGGSLRLSCAASGFTFSSYAMSWVRQAPGKGLEWVSAISGSGGSTYYAYSVKGRFTISRDNSKNTLYLQMNSLRAEDTAVYYCARDQHDILTGGYYGMDVWGKGTMVTVSSGGGGSGGGGSGGGGSQSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLG

SEQ ID NO: 1462 - protein, 252 aa, Homo sapiens
EVQLVQSGAEVKKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGKGTLVTVSSGGGGSGGGGSGGGGSQSVLTQPASVSGSPGQSITISCTGTSSDVGGYNYVSWYQQHPGKAPKLMIYEGSKRPSGIPDRFSGSSSGNTASLTITGAQAEDEADYYCNSRDSSGNHVVFGGGTKLTVLG

SEQ ID NO: 1463 - protein, 256 aa, Homo sapiens
  Site (49): Xaa equals any of the naturally occurring L-amino acids
  Site (53): Xaa equals any of the naturally occurring L-amino acids
  Site (54): Xaa equals any of the naturally occurring L-amino acids
RVQCQKSGGGLVQPGRSRRLSCAASGFTFKNYDVHWVRQAPGKGLEWVXRTRXXANSYTTEYAASVKGRFTISRDDSKNSLYLQMNSLKTEDTAVYYCAREGTYYDILTGYYPLGYFDYWGQGTMVTVSSGGGGSGGGGSGGGGSQSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLG

SEQ ID NO: 1464 - protein, 245 aa, Homo sapiens
QVQLQQSGAEVKKPGSSVKVSCKASGGTFSNYAFSWVRQAPGQGLEWMGGIIPIFGTANYAQKLQGRVTITADELTRTVYMDLSSLRSEDTAVYYCATGMGDHYGMDVWGQGTLVTVSSGGGGSGGGGSGGGGSQSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLG

SEQ ID NO: 1465 - protein, 248 aa, Homo sapiens
EVQLVETGAEVKKPGSSVKVSCKASGGIFSSNGFSWVRQAPGQGLEWMGAIIPMFKTAHYAQNFQGRVTINADELTRTVYMELSSLRSEDTAVYYCARGGSSQNFYGMDVWGQGTLVTVSSGGGGSGGGGSGGGGSAQSVLTQPPSVSAAPGQKVTISCSGTSSNIGNNYVSWYQQFPGAAPKLLIYDNGKRPSGIPDRFSGSKSGTSATLAIAGLQTGDEADYYCGTWDSSLSAVVFGGGTKVTVLG

SEQ ID NO: 1466 - protein, 254 aa, Homo sapiens
QVQLVQSGAEVKKPGASVKVSCEASAELFASSDINWVRRATGQGLEWMGWVNPSSGNAGYAEKFEGRVSMTTNIPKKTVYMELSSLTSEDTAVYYCARGTGYDILTGYYMGSAFDQWGRGTLVTVSSGGGGSGGGGSGGGGSAQSVLTQPPSASGTPGQTVTISCSGGGTNIGRDRVTWYQQVPGTPPKLLIYKTSQRPSRVPDRFSASKSGTSASLDISGLRSEDEADYYCVVWDDSLRGYVFGTGTKVTVLG

SEQ ID NO: 1467 - protein, 252 aa, Homo sapiens
EVQLVQSGAEVKKPGSSVKVSCRASGGTFSRSAINWVRQAPGQGLEWIGGSIPIFGPPNYAQKFQGRVILTADELTTTAYMELSGLRSDDTAVYYCARGVVWVAYGDVGIYGFDVWGQGTLVTVSSGGGGSGGGGSGGGGSAQSALTQPASVSGSPGQSITISCTGSSTDLGDYSSVSWYQQHPGKAPKLIIYDVNNRPSGVSDRFSGSKSGNTASLTISALQADDEADYHCGSYTDHLTRFGGGTKLTVLG

SEQ ID NO: 1468 - protein, 251 aa, Homo sapiens
EVQLVQSGAEVKKPGSSVKVSCKASGYTFTSYGFNWVRQAPGQGLEWMGRIIPDFETTYYSQKLQDRVTMTADTCTSTSYMELNSLRSDDTAIYYCARHDYYIMTAAHYYYDSWGQGTLVTVSSGGGGSGGGGSGGGGSALSSELTQDPAVSVALGQTVRITCQGDSLRSYYASWYQQKPGQAPVLVIYGKNSRPSGIPDRFSGSSSGNTASLTITGAQAEDEADYYCNSRDSSGIHLGVFGGGTKVTVLG

SEQ ID NO: 1469 - protein, 254 aa, Homo sapiens
QVQLVQSGPDVKNPGASVRVSCKASGYNFLNYDINWVRQTPGQGLEWMGWMNPKSGKTDSAEKFQGRVTMTTDTSRNTVYMELSRLSSDDTAVYFCARGIGYDLLTGYFTGSPLDYWGQGTLVTVSSGGGGSGGGGSGGGGSAQSVLTQPPSASGTPGQRVTISCSGSTSNIGNNYVYWYQQLPGTAPKLLIYRNNQRPSGVPDRFSGSKSGTSASLAISGLRSEDEADYYCATWDGSLSGPVFGGGTKLTVLG

SEQ ID NO: 1470 - protein, 247 aa, Homo sapiens
QVQLVQSGGGLVQPGRSLRLSCAASGFTFSSYWMSWVRQAPGKGLEWVANIKQDGSEKYYVDSVKGRFTISRDNAKNSLYLQMNSLRAEDTAVYYCARDFYDILTGYHDAFDIWGRGTMVTVSSGGGGSGGGGSGGGGSSELTQDPAVSVALGQTVRITCQGDSLRSYYASWYQQKPGQAPVLVVYAKNKRPSGIPDRFSGSSSGNTASLTITGAQAEDEADYYCNSRDSSGNHVVFGGGTKLTVLG

SEQ ID NO: 1471 - protein, 250 aa, Homo sapiens
QVQLVQSGGGLVKPGGSLRLSCAAPGFTFSNAWMSWVRQAPGKGLEWVGRIKSKTDGGTADYAAPVKGRFTISRDDSKNTLYLQMNSLKTEDTDVYYCTTDVDDILTGYSWDYWGRGTMVTVSSGGGGSGGGGSGGGGSQSVLTQPASVSGSPGQSITISCTGTSSDIGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1472 - protein, 248 aa, Homo sapiens
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARMEYDILTGYYGGYFDYWGQGTMVTVSSGGGGSGGGGSGGGGSSELTQDPAVSVALGQTVRITCQGDSLRSYYTNWFQQKPGQAPVLVIYGKNNRPSGIPDRFSGSSSGNTASLTITGAQAEDEADYYCNSRDSSGNHVVFGGGTKLTVLG

SEQ ID NO: 1473 - protein, 251 aa, Homo sapiens
QVQLQQSGAEVKKPGASVKVSCKASGYTFTKYTMHWVRQAPGQGPEWMGWINGGSGDTKYSRKFQGRVTITKDTSASAAYMELSSLGSEDTALYYCARAAYDPLTGYSFDGFDIWGQGTLVTVSSGGGGSGGGGSGGGGSQSVLTQPASVSGSPGQSITISCTGTSSDVGGHNYVSWYQQHPGKAPKLMIYEGSKRPSGVSNRFSGSKSGNTASLTISGLQAKDEADYYCSSYTTRSTRVFGGGTKLTVLG

SEQ ID NO: 1474 - protein, 250 aa, Homo sapiens
EVQLVESGGGVVQPGRSLRLSCKGSGYSFSRYGISWVRQAPGQGLEWMGWISGYNGNTNYAQNFQGRATMTTDTSTSTAYMELRGLRSDDTAVYYCARDMHYDILTGYYTGLAFDMWGRGTMVTVSSGGGGSGGGGSGGGGSSELTQDPAVSVALGQTVRITCQGDSLRSYYASWYQQKPGQAPVLVTYGKNNRPSGIPDRFSGSSSGNTASLTITGAQAEDEADYYCNSRDSSGNHVVFGGGTKLTVLG

SEQ ID NO: 1475 - protein, 252 aa, Homo sapiens
  Site (27): Xaa equals any of the naturally occurring L-amino acids
  Site (30): Xaa equals any of the naturally occurring L-amino acids
QVQLGAVLGAKVKKPGSSVKVSCRASXGTXRGYTVNWVRQAPGQGLEWMGRINPMSNGANYAQKFQGRVTITADKSTSTAYLDLSSLRSEDTAMYYCARGGYDILTQYPAEFFHPWGQGTLVTVSSGGGGSGGGGSGGGGSALSSELTQDPAVSVALGQTVTITCQGDSVRNFYASWYQQKPGQAPLLVIYGQNNRPSGIPDRFSGSRSGNTASLTITGAQAEDEGVYYCNSRDSSTNPVVFGGGTKVTVLG

SEQ ID NO: 1476 - protein, 248 aa, Homo sapiens
QVQLQQSGAEVKKPGASVKVSCKASGYTFSSSGISWVRQAPGQGLEWLGGIIPISNSPVYAQKFQDRVTITADRLTTTAFLELTGLKHEDTAVYYCARDFGVIGDYRPFDYWGQGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1477 - protein, 245 aa, Homo sapiens
GVQLVQSGAELKKPGSSVKVSCKASGSSFSDYAISWVRQAPGQGLEWMGETVPILGTQTYAQKFQGRVTISADELTRTTFMELSSLRSEDTAVYYCAKSSNPVYGLDVWGRGTMVTVSSGGGGSGGGGSGGGGSQSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLG

SEQ ID NO: 1478 - protein, 251 aa, Homo sapiens
QVQLQQSGAEVKKPGASVKVSCKASGYTFTKYTMHWVRQASGQGPEWMGWINGGSGDTKYSRKFQGRVTITKDTSASAAYMELSSLGSEDTALYYCARATYDPLTGYSFDGFDIWGQGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1479 - protein, 251 aa, Homo sapiens
QVQLVQSGAEVKKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGQGTTVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1480 - protein, 250 aa, Homo sapiens
QVQLVQSGAEVKKPGASVKVSCKTSGYSFDNYGITWVRQAPGQGLEWMGWISAYDGDRNYAQKLRGRVTMTTDTSTSTAYMELRSLRPDDTAVYYCARDDRDILTNYYLEYFQHWGKGTLVTVSSGGGGSGGGGSGGGGSAQSVLTQPPSVSVSPGQTASITCSGHNLGDKYVSWYQQKPGQSPVLVIYQDTKRPSGIPERFSGSNSGNTATLTISGTQAMDEADYSCQTWDGSTSSVVFGGGTKLTVLG

SEQ ID NO: 1481 - protein, 259 aa, Homo sapiens
QVQLVQSGAEVKKPGSSVKVSCRVSGGSFTDDSINWLRQAPGQGLEWVGGTIPLANRANYAQKFRDRVTITADELTATVFLELTSLRSDDTALYYCARSSPPKWYDALTGDSSYHSAMDVWGRGTLVTVSSGGGGSGGGGSGGGGSAQSVLTQPPSASGTPGQKVTISCSGSSSNIGGHTVNWYQQFPGTAPKLLIFSNNQRPSGVPARFSGSKSGTSASLAISGLQSEDEADYYCAAWDDSLNGHWVFGGGTKLTVLG

SEQ ID NO: 1482 - protein, 253 aa, Homo sapiens
QVQLQQSGAEVKKPGSSVKVSCKASGGTFSSYALSWVRQAPGQGLEWMGRIVPILGRTNYAQKFQGRVTITADKSTSTAYMELSSLRSEDTAVYYCARDKTLGDQLVEAYYYDGMDVWGQGTLVTVSSGGGGSGGGGSGGGGSALSSELTQDPTVSVALGQTVRITCQGDSLTTYYGSWYQHKPGQAPVLVIFGNNNRPSRIPDRFSGSRSGNTASLTITGAQAEDEADYYCHSRDNSDNDVFGGGTKLTVLG

SEQ ID NO: 1483 - protein, 255 aa, Homo sapiens
EVQLVQSGAEVKNPGSSVKVSCKASGGTFRSHTFAWVRQAPGQGLEWMGGIIPMFDTAVYAQKFQGRVTITADESTSTASMELSSLRSEDTAVYYCAKLGRTSRDLLTGYHFYNMDVWGRGTLVTVSSGGGGSGGGGSGGGGSALSSELTQDPAVSVALGQTVRITCQGDSLRGSYANWYRQKPGQAPVLVMYGRNNRPSGIPDRFSGSKSGNTASLTITGAQAEDEADYYCNSRDSSGNPDVVFGGGTKVTVLG

SEQ ID NO: 1484 - protein, 250 aa, Homo sapiens
QVQLVQSGAEVKKPGSSVKVSCKASGDTFSSYGFSWVRQAPGQGLEWMGRVVPGFETTNYSQKFQGRVTITADKWTATSYMELNGLRSEDTAIYYCARDDYDILTGSLYYFDSWGRGTLVTVSSGGGGSGGGGSGGGGSALSSELTQDPAVSVALGQTVRITCQGDNLRTYPPTWYQQKPGQAPVLVIYGKNNRPLGIPDRFSGFNSGNTASLTISGAQAEDEADYYCSSRDYSGNQVIFGGGTKVTVLG

SEQ ID NO: 1485 - protein, 259 aa, Homo sapiens
EVQLVQSGAEVKKPGASVKVSCEASAELFASSDINWVRRATGQGLEWMGWVNPSSGNAGYAEKFEGRVSMTTNIPKKTVYMELSSLTSEDTADYYCARGTGYDILTGYYMGSAFDQWGQGTLVTVSSGGGGSGGGGSGGGGSAQAVLTQPSSLSASPGASASLTCTLRSDINLETSRIYWFQQKPGSPPRYLLRYQSDSDNHLDSGVPSRFSGSKDASANAGILLISGVQSEDEADYHCMIWHSGGSVFGGGTKLTVLG

SEQ ID NO: 1486 - protein, 250 aa, Homo sapiens
  Site (52): Xaa equals any of the naturally occurring L-amino acids
  Site (84): Xaa equals any of the naturally occurring L-amino acids
QMQLVQSGGGLIQPGGSLRLSCKASGLTFNSHWMSWVRQGPGKGLEWLANIXQDGSEKYYMDSVKGRFTISRDNAKNSLYLQMXSLRAEDTAVYYCVRDRADILTGYNDAFDIWGRGTLVTVSSGGGGSGGGGSGGGGSALSSELTQDPAMSVALGQTVWITCQGDSLRSSYASWYQQKPGQAPVLVMYAKNKRPSGIPDRFSGSSSGNTASLTITGAQAEDEADYYCDSRDSSRHHVMFGGGTKLTVLG

SEQ ID NO: 1487 - protein, 251 aa, Homo sapiens
EVQLVQSGPEVKKPGSSVKVSCKASGGTFSSYAFNWVRRAPGQGLEWLGSIVPVFNTKTFARKFQGRVTLTADELTRTAYLELSNLRSDDTAVYYCASRYGDPFYYYYYMNVWGRGTLVTVSSGGGGSGGGGSGGGGSAQSVLTQPPSVSGAPGQRVTISCTGSSSNIGAGYDVHWYQQLPGAAPKLLIHTNTNRPSGVPDRFSGSKSGTSASLAITGLQAEDEADYYCQSYDRSLSAWVFGGGTKLTVLG

SEQ ID NO: 1488 - protein, 253 aa, Homo sapiens
EVQLVQSGAEVKKPGASVKVSCEASAELFASSDINWVRRATGQGLEWMGWVNPSSGNAGYAEKFEGRVSMTTNIPKKTVYMELSSLTSEDTAVYYCARGTGYDILTGYYMGSAFDQWGQGTLVTVSSGGGGSGGGGSGGGGSALSYVLTQPPSVSVSPGQTASITCSGDKLRNKYAFWYQQRPGQSPALIIYQDNKRPSGIPERFSGSNAGNTATLTISGTLAMDEAVYYCQTWDSSAGNALFGGGTKLTVLG

SEQ ID NO: 1489 - protein, 254 aa, Homo sapiens
QLQLQESGAEVKKPGASVKVSCKASGYTFSDYSLHWVRQAPGQGLEWMGWINPKSGATNSAQKFQGRVTMTRDTSISTVYMELSRLRSDDTAVYYCARVSNDILTGWGGYNWFDPWGRGTLVTVSSGGGGSGGGGSGGGGSAQSVLTQPPSVSGAPGQRVTISCTGSSSNIGAGYDVHWYQQVPGTAPKLLIFNNSGRPSGVPDRYSGSKSGTSASLAITGLQAEDEADYYCQSYDSSLSGVVFGGGTKVTVLG

SEQ ID NO: 1490 - protein, 253 aa, Homo sapiens
QVQLVQSGAEVKKPGASVKVSCEASAELFASSDINWVRQATGQGLEWMGWVNPSSGNAGYAEKFEGRVSMTTNIPKKTVYMELSSLTSEDTAVYYCARGTGYDILTGYYMGSAFDQWGKGTMVTVSSGGGGSGGGGSGGGGSALSSELTQDPAVSVALGQTVRITCQGDSLRNYFASWYQQKPGQAPLLIIYGKTNRPSGIPDRFSGSRSGNTASLTITGAQAKDEADYYCSSRDSSGNHVVFGGGTKLTVLG

SEQ ID NO: 1491 - protein, 244 aa, Homo sapiens
QVQLVQSGAEVKKPGSSVKVSCKASGGTVSSRTISWVRQAPGQGLEWMGGSLPPSGAPIYAQKFQGRVAITADALTNTAFMELRSLKSDDTAVYYCARDQGRYLDLWGRGTLVTVSSGGGGSGGGGSGGGGSAQSVLTQPPSTSGTPGQRVTISCSGSSSNIGSNYVYWYQQFPGTAPKLLINRNNQRPSGVPDRFSGSKSGTSASLAISGLRSEDEADYYCAAWDDSLSGYVFGTGTKVTVLG

SEQ ID NO: 1492 - protein, 247 aa, Homo sapiens
EVQLVQSGAEVKKPGSSVKVSCKASGGTVSSRTISWVRQAPGQGLEWMGGSLPPSGAPIYAQKFQGRVAITADALTNTAFMELRSLKSDDTAVYYCARDQGRYLDLWGKGTLVTVSSGGGGSGGGGSGGGGSAQAVLTQPSSVSGAPGQRVTISCTRSGSNIGAGNDVHWYQQFPGTAPKLLIYANNNRPSGVPDRFSGSKSGTSASLAITGLQAEDEADYYCQSYDNRLSGGDVVFGGGTKLTVLG

SEQ ID NO: 1493 - protein, 252 aa, Homo sapiens
QVQLVQSGAEVKKPGSSVKVSCRASGGSFNHAISWVRQAPGRGLEWMGGILPMYGTANYAQKFQGRVTITADKLTNTVYMDLSRLRYEDTAVYYCARELGLSIVGATTGALDMWGQGTMVTVSSGGGGSGGGGSGGGGSAQAVLTQPSSASGTPGQRVTISCSGSTSNIATNAVNWYQQLPGTAPKLLIYSNTERPSGVPDRFSGSKSGTSASLAISGLQSEDEADYYCATWDDSLAGQGVFGGGTKLTVLG

SEQ ID NO: 1494 - protein, 257 aa, Homo sapiens
QVQLVESGAEVKKPGASVKVSCEASAELFASSDINWVRRATGQGLEWMGWVNPSSGNAGYAEKFEGRVSMTTNIPKKTVYMELSSLSSEDTAVYYCARGTGYDILTGYYMGSAFDQWGKGTLVTVSSGGGGSGGGGSGGGGSAQAVLTQPSSVSGAPGQRVTISCTGNSSNIGAGYEVHWYQLVPGTAPKLLIYGNTNRPSGVPDRFSASKSGTSASLAITGLQAEDEANYYCQSYDRSLSGSHAVFGGGTKLTVLG

SEQ ID NO: 1495 - protein, 252 aa, Homo sapiens
EVQLVETGAEVKKPGASVKVSCKASGYTFTSSGISWVRQAPGQGLEWMGWISAYNGNTNYAQKLQGRVTMTTDTSTSTAYMELRSLRSDDTAVYYCARTYYDILTGYYAEYFQHWGRGTLVTVSSGGGGSGGGGSGGGGSAQSVVTQPPSVSAAPGQRVTISCSGSSSNIGINSVSWYQQLPGKAPKLLIYNNSNRPSGVPGRFSGSKSGTSASLAITGLQAEDEADYYCQSYDNSLNGVLFGGGTQLTVLS

SEQ ID NO: 1496 - protein, 251 aa, Homo sapiens
QVQLVQSGAEVKKPGASVKVSCKASGYSFTSYAIHWVRQAPGQRLEWMGWINVGNGNTKYSQKLQGRVTITRDISASTAYMELSSLRSEDTAVYYCARSDYDILTGYYWVPAVWGQGTMVTVSSGGGGSGGGGSGGGGSAQSVLTQPPSASGSPGQSVTISCTGGSSDVGGYNYVSWYQQYPGKAPKLIVNEVNKRPSGVPDRFSGSKSGNTASLTVSGLQAEDEANYYCASYAGNNNVVFGGGTKVTVLG

SEQ ID NO: 1497 - protein, 259 aa, Homo sapiens
QVQLVQSGAEVKKPGSSVKVSCKASGGTFSSYAISWVRQAPGQGLEWMGGMIPTFGTAIYAQKFQGRVTITADALTNTAFMELRSLKSDDTAVYYCARGREDTDKVKPWDRYFHYYYMDVWGRGTLVTVSSGGGGSGGGGSGGGGSAQSVLTQPPSVSGAPGQRVTISCTGSSSNIGAGYDVHWYQQLPGTAPKLLIYGNSNRPSGVPDRFSGSRSGTSASLAITGLQAEDEADYYCQSYDSSLSGSVFGGGTKVTVLG

SEQ ID NO: 1498 - protein, 244 aa, Homo sapiens
EVQLVQSGAEVKKPGSSVKVSCKASGGTVSSRTISWVRQAPGQGLEWMGGSLPPSGAPIYAQKFQGRVAITADALTNTAFMELRSLKSDDTAVYYCARDQGRYLDLWGQGTLVTVSSGGGGSGGGGSGGGGSAQSVLTQPPSASGAPGHSVTISCSGSSSNIGGNSVYWYQQVPGTAPKLLIYDNGKRPSGIPDRFSGSKSGTSATLAIAGLQTGDEADYYCGTWDSSLSAVVFGGGTKVTVLG

SEQ ID NO: 1499 - protein, 253 aa, Homo sapiens
EVQLVQSGAEVKKPGASVKVSCEASAEVFASSDINWMRRATGQGLEWMGWVNPSSGNAGYAEKFEGRVSMTTNIPKKTVYMELTRLTSEDTAVYYCARGTGYDILTGYYMGSVFDPWGQGTTVTVSSGGGGSGGGGSGGGGSALETTLTQSPGTLSLSPGERATLSCRASQSVRNSYLAWYQQKPGQAPRLLIYGASSRATGIPDRFSGSGSGTDFTLTISRLEPEDFAVYYCQQYGSSPVTFGGGTKVEIKR

SEQ ID NO: 1500 - protein, 252 aa, Homo sapiens
QVQLVQSGPEVKKPGASVKVSCKASGYSFSTHGITWVRQAPGQGLEWMGWISGYNGNTNFAQKVQGRVTMTTDTSTSTAYMELRSLRSDDTAVYFCARSYYDILTGYYHTPLDYWGKGTLVTVSSGGGGSGGGGSGGGGSALPVLTQPPSASGTPGQRVTISCSGSSSNIGSNTVNWYQQLPGTAPKLLIYSNNQRPSGVPDRFSGSRSGTSASLAISGLQSEDQADYYCAAWDDSLNAVVFGGGTKVTVLG

SEQ ID NO: 1501 - protein, 251 aa, Homo sapiens
QVQLVQSGAEVKKPGSSVKVSCRASGGSFNHAISWVRQAPGRGLEWMGGILPMYGTANYAQKFQGRVTITADKLTNTVYMDLSRLRYEDTAVYYCARELGLSIVGATTGALDMWGKGTMVTVSSGGGGSGGGGSGGGGSAQSVLTQPPSVSAAPGQKVTISCSGSSSNIGQNYVSWYQVFPGTAPKLLIYDSHRRPSGIPDRFSASTSDTAATLAITGLQTGDEADYFCGAWDSKLNAYVFGTGTQLTVLS

SEQ ID NO: 1502 - protein, 253 aa, Homo sapiens
QVQLVQSGAEVKKPGASVKVSCEASAELFASSDINWVRQATGQGLEWMGWVNPSSGNAGYAEKFEGRVIMTTNIPKKTVYMELSSLTSEDTAVYYCARGTGYDILTGYYMGSAFDQWGRGTLVTVSSGGGGSGGGGSGGGGSALSYVLTQPPSLSVSPGQTASITCSGDKLGDKYVSWYQQKPGQSPVMVIYQDRKRPSGIPERFSGSNSGNAATLTISGTQAMDEAEYYCQAWDRTTADVVFGGGTKVTVLG

SEQ ID NO: 1503 - protein, 261 aa, Homo sapiens
EVQLQLVESGGGVVQPGRSLRLSCAASGFTFSNFDIHWVRQAPGKGLEWVAVISYNGRTKYYLDSVKGRFIISRDNSKHTVDLQMSSLRAEDTAVYYCAKGGGYDILTGYSYPYLYYGLDVWGRGTMVTVSSGGGGSGGGGSGGGGSALSYELTQPPSASGTPGQRVTISCSGSSSNIGSNTVNWYQQVPGTAPKLLIYSNSHRSSGVPDRFSGSKSGTSASLAISGLQSEDEAAYYCESRDDSLNGNVVFGGGTKLTVLG

SEQ ID NO: 1504 - protein, 255 aa, Homo sapiens
EVQLVQSGADVKKPGASVKVSCKASGYNFMNYDINWVRQAPGEGLEWMGWMNPNSGKTDSAEKFQGRVTMTTDTSRDTVYMELSRLRSDDTAVYFCARGRGYDVLTGYFTGSPLDYWGRGTLVTVSSGGGGSGGGGSGGGGSAQAVLTQPSSVSGAPGQRVTISCTGISSNIGAGYDVHWYQHLPGTAPKLLIYGNTNRPSGVPDRFSGSKSGASASLAITGLQAEDEANYYCQSYDNRLSGHVFGTGTKLTVLG

SEQ ID NO: 1505 - protein, 252 aa, Homo sapiens
QVQLVQSGAEVKKPGSSVKVSCRASGGSFNHAISWVRQAPGRGLEWMGGILPMYGTANYAQKFQGRVTITADKLTNTVYMDLIRLRYEDTAVYYCARELGLSIVGATTGALDMWGRGTLVTVSSGGGGSGGGGSGGGGSAQAVLTQPSSVSGAPGQRVTISCTGSSSNIGSSDDVHWYQQLPGTAPRLVIYGNDNRPSGVPDRFSASKSGTSASLAITGLQAEDEADYYCQSYDSSLSSAVFGGGTKLTVLG

SEQ ID NO: 1506 - protein, 252 aa, Homo sapiens
QVQLVQSGAEVKKPGSSVKVSCRASGGSFNHAISWVRQAPARGLEWMGGILPMYGTANYAQKFQGKVTITADKLTITVYMDLIRLRYEDTAVYYCARELGLSIVGATTGALDMWGRGTLVTVSSGGGGSGGGGSGGGGSAQAVLTQPSSVSGAPGQRVTISCTGSSSNIGSSVDVHWYQQLPGTAPRLVIYGNENRPSGVPDRFSASKSGTSASLAITGLQAEDEADYYCQSYDSSLSSAVFGGGTKLTVLG

SEQ ID NO: 1507 - protein, 244 aa, Homo sapiens
QVQLVQSGAEVKKPGASVKVSCQASGYTFREYGIIWARQAPGQGLEWMGWISGQNGKTNLAQRFQGRVTITTDTLTSTAFMELTNLRVDDTVMYYCAASGPGWFDPWGKGTLVTVSSGGGGSGGGGSGGGGSAQSVLTQPPSASGTPGQRVTISCSGSSSNIGSNTVNWYQQLPGTAPKLLIYSNNQRPSGVPDRFSGSKSGTSASLAISGLQSEDGADYYCAAWDDSLNGYVFGTGTKLTVLG

SEQ ID NO: 1508 - protein, 254 aa, Homo sapiens
EVQLVQSGAEVKKPGSSVKVSCKASGGRFNRYATTWVRQAPGQGLEWMGGIIPLFGTTKYAQRLQGRVTITADELTNTAFMELRSLRSEDTALYYCATTDRFGAKDVTARWGMDVWGQGTLVTVSSGGGGSGGGGSGGGGSAQAVLTQPSSVSGAPGQRVTISCTGSSSNIGAGYDVHWYQQLPGTAPKLLIYGNSNRPSVVPDRFSGSKSGTSASLAITGLQAEDEADYYCQSYDSSLSGYVFGTGTKVTVLG

SEQ ID NO: 1509 - protein, 253 aa, Homo sapiens
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCAREQGYDILTGYYPEGGWFDPWGKGTMVTVSSGGGGSGGGGSGGGGSALSSELTQDPAVSVALGQTVRITCQGDSLRSYYASWYQQKPGQAPVLVIYGKNNRPSGIPDRFSGSSSGNTASLTITGAQAEDEADYYCNSRDSSGNPVFGGGTKLTVLG

SEQ ID NO: 1510 - protein, 251 aa, Homo sapiens
QVQLQESGPGVVKPSETLSLTCTVSGGFISSRTSYWGWIRQPPGKGLEWIGNIYYTGKTYYSPSLKSRVTISADTSKNQLSLKLSSVTAADTAVYYCARAGYDLLTGYPFYFDSWGRGTLVTVSSGGGGSGGGGSGGGGSAQAVLTQPSSASGTPGQRVTISCSGSSSNIGSTTVAWYQQVPGTAPKLLIYSNDRRPSGVPDRFSGSKSGTSASLAISGLQSEDEADYYCASWDDSPHVVFGGGTKLTVLG

SEQ ID NO: 1511 - protein, 254 aa, Homo sapiens
QVQLVESGGGLVQPGGSLRLSCAASGFTFNKYEMNWVRQAPGKGLEWVANIKEDGREKYYVDSVKGRFTISRDDAKNSLYLQMNSLRVEDTALYYCVRGRNYYDFLTGYNFNLGLDYWGQGTLVTVSSGGGGSGGGGSGGGGSALSSELTQDPAVSVALGQTVRITCQGDSLRNYYASWYQQKPGQAPVLVIYGKNNRPSGIPDRFSGSSSGITASLTITGAQADDEADYYCNSRDTTGHHLVFGGGTQLTVLS

SEQ ID NO: 1512 - protein, 251 aa, Homo sapiens
QVQLQESGGGVVQPGRSLRLSCAASEFTFSNYAMHWVRQAPGKGLEWVAVISYDGTYKSYADSMKGRFTISRDNSKNSLYLQMNSLRAEDTAVYYCARENYDSLTGYYNYFDYWGQGTLVTVSSGGGGSGGGGSGGGGSAQAVLTQPSSDSGTPGQRVTISCSGSGSNIGSNAVSWYQQLPGTAPKLLIYSNNLRPSGVPDRFSGSKSATSAALAISGLQSEDEADYYCAAWDDTLNAEVFGGGTKVTVLG

SEQ ID NO: 1513 - protein, 244 aa, Homo sapiens
QVQLQQSGAEVKKPGSSVKVSCKASGGTVSGRTINWVRQAPGQGLEWMGGSDPPYGEPIYAQKFQDRVTITEDTLTNTAYMELRSLTSDDTAVYYCARDQRKAQDIWGRGTMVTVSSGGGGSGGGGSGGGGSAQSVLTQPPSVSGTPGQRVTISCSGGSANIGTIYVNWYQQVPGAAPKLLMYRNNQRPSGVFDRFSGSKSGTSASLAISGLRSEDESDYYCATWDDSLRRVVFGGGTKLTVLG

SEQ ID NO: 1514 - protein, 257 aa, Homo sapiens
EVQLVQSGAEVKKPGESLKISCQGSGYTFTDYWISWVRQMPGKGLEWMGRIDPSNSYDDYSPSFKGRVIISSDESNATAYLVWDSLQASDSATYYCARLKAPYYDLLTGYHLPKWFDTWGQGTLVTVSSGGGGSGGGGSGGGGSALSYELTQPPSASGTPGQRVTISCSGNTSNIGTNYVNWYQQLPGTAPKLLIYRNHQWPSGVPDRFSGSKSGTSASLAISGLRSEDEADYYCAAWDDSLRGYVFGTGTKVTVLG

SEQ ID NO: 1515 - protein, 243 aa, Homo sapiens
QVQLVQSGAEVKKPGSSVKVSCKASGGTVSSRTISWVRQAPGQGLEWMGGSLPPSGAPIYAQKFQGRVAITADALTNTAFMELRSLKSDDTAVYYCARDQGRYLDLWGKGTLVTVSSGGGGSGGGGSGGGGSALSYELTQPPSVSVAPGKTARITCGGDNIGSKSVHWYQQKPGQAPVLVTDYDIDRPSGIPERFSGSKSGNTATLTISRVEGGDEADYYCQVWDSVTDHVVFGGGTKVTVLG

SEQ ID NO: 1516 - protein, 245 aa, Homo sapiens
QVQLVQSGAEVKKPGSSVKVSCKASGGTVSSRTISWVRQAPGQGLEWMGGSLPPSGAPIYAQKFQGRVAITADALTNTAFMELRSLKSDDTAVYYCARDQGRYLDLWGQGTLVTVSSGGGGSGGGGSGGGGSAQAVLTQPSSVSGAPGQRVTISCTGSRSNIGTGYDVHWYQQLPGTAPKLLIYADNNRPSGVPDRFSGSKSGTSASLAITGLQAEDEADYYCQSHDSSLGGSVFGGGTKVTVLG

SEQ ID NO: 1517 - protein, 252 aa, Homo sapiens
QVQLVQSGAEVKKPGSSVKVSCRASGGSFNHAISWVRQAPGRGLEWMGGILPMYGTANYAQKFQGRVTITADKLTNTVYVDLSRLRYEDTAVYYCARELGLSIVGATTGALDMWGRGTLVTVSSGGGGSGGGGSGGGGSAQSVLTQPPSASGTPGQWVTIPCSGSSSNIGSNTVNWYQHLPGTAPKLLIYSNNQRPSGVPDRFSGSKSGTSASLAISGLQSEDEANYYCAAWDDSLNGHVVFGGGTKLTVLG

SEQ ID NO: 1518 - protein, 252 aa, Homo sapiens
QVQLVQSGTEVKKPGSAVKVSCKASGGTFSSRGVSWVRQAPGQGLEWMGGIGPMSGTPNYAQKFQGRVTMTADESTSTAYLELSNLRSEDTAVYYCATGRYYDMLTRGGYFDYWGKGTMVTVSSGGGGSGGGGSGGGGSAQAVLTQPSSASGTPGQRVTVSCSGSSSNIGYNSVNWYQQLPGTAPKLLIYSNSQRPSGVPDRFSGSKSGTSASLAISGLQSEDEADYYCAAWYDSLSGHVVFGGGTQLTVLS

SEQ ID NO: 1519 - protein, 252 aa, Homo sapiens
QVQLQESGGGVVQPGRSLRLSCAASGFTFSSYGMHWVRQAPGKGLEWVAVISYDGSNKYYADSVKGRFTISRDNSKNTLYLQMNSLRAEDTAVYYCAKRQYDILTGYYGGFDYWGQGTMVTVSSGGGGSGGGGSGGGGSAQAVLTQPSSVSGAPGQRVSVSCTGSSSNIGAGYDVHWYQQFPGTAPKLLIYGNNNRPSGVPDRFSVSKSGTSASLAITGLQAEDEADYYCQSYDSSLSGTIFGTGTKVTVLG

SEQ ID NO: 1520 - protein, 253 aa, Homo sapiens
EVQLVQSGGEVKRPGASVKVSCKASGYTFSRYGISWVRQAPGQGLEWMGWISAYNGKTSFAEKFQGRVTLTTDTSTTTVDMELRNLRSDDTAVYYCARTDYDILTGYPMGYFDPWGRGTLVTVSSGGGGSGGGGSGGGGSAQSVVTQPPSAPGSPGQSVTISCTGTSSDVGGYKYVSWYQQHPGKAPKLMIYEVNKRPSGVPDRFSGSKSGNTASLTVSGLQAEDEADYYCSSYEGSNNAYVFGTGTKLTVLG

SEQ ID NO: 1521 - protein, 245 aa, Homo sapiens
QVQLVQSGAEVKKPGSSVKVSCKASGGTVSSRTISWVRQAPGQGLEWMGGSLPPSGAPIYAQKFQGRVAITADALTNTAFMELRSLKSDDTAVYYCARDQGRYLDLWGRGTMVTVSSGGGGSGGGGSGGGGSAQAVLTQPSSVSGAPGQRVTISCTGSSSNIGAGYDVHWYQQLPGTVPKLLIYGDSHRPSGVPDRFSGSKSGTSASLAITGLQAEDEADYYCQSFDNSLSASIFGGGTKLTVLG

SEQ ID NO: 1522 - protein, 254 aa, Homo sapiens
QVQLVQSGAEVKKPGASVKVSCEASAELFASSDINWVRRATGQGLEWMGWVNPSSGNAGYAEKFEGRVSMTTNIPKKTVYMELSSLTSEDTAVYYCARGTGYDILTGYYMGSAFDQWGRGTLVTVSSGGGGSGGGGSGGGGSAQSVLTQPPSMSAAPGQKVTIPCSGGSSNIGTRYVSWYQQVPGTVPKLIIYDNDKRPSGISDRFSGSKSGTSAFLGITGLQTGDEADYYCGTWDRSLNAGVFGGGTKVTVLG

SEQ ID NO: 1523 - protein, 245 aa, Homo sapiens
QVQLVQSGAEVKKPGSSVKVSCKASGGTVSSRTISWVRQAPGQGLEWMGGSLPPSGAPIYAQKFQGRVAITADALTNTAFMELRSLKSDDTAVYYCARDQGRYLDLWGKGTLVTVSSGGGGSGGGGSGGGGSAQTVVIQEPSLTVSPGGTVTLTCASITGAVTSGNYPNWFQQKPGQAPRALIYSTDNKHSWTPARFSGSLLGDKAALTLSGVQPEDEADYYCLLYYGGAQPWVFGGGTKVTVLG

SEQ ID NO: 1524 - protein, 244 aa, Homo sapiens
QVQLVQSGAEVKKPGSSVKVSCKASGGTVSSRTISWVRQAPGQGLEWMGGSLPPTGAPIYAQKFQGRVAITADALTNTAFMELRSLKSDDTAVYYCARDQGRYLDLWGRGTMVTVSSGGGGSGGGGSGGGGSALPVLTQPPSASGTPGQRVTISCSGSSSNIGSNTVNWYQQLPGTAPKLLIYTNNQRPSGVPDRVSGSKSGTSASLAISGLQSEDEADYYCAAWDDSFNGWVFGGGTKLTVLG

SEQ ID NO: 1525 - protein, 254 aa, Homo sapiens
QVQLVQSGADVKKPGASVKVSCKASGYNFMNYDINWVRQAPGEGLEWMGWMNPKSGKTDSAEKFEGRVTMTTDTSRDTVYMELSRLRSDDTAAYFCARGSGYDLLTGYFTGSPLDYWGRGTMVTVSSGGGGSGGGGSGGGGSAQSALTQPASVSGSPGQSITISCTGTSSDVGGYKYVSWYQQHPGKAPKLMIHDVSNRPSGVSNRFSGSKSGNTASLSISGLQAEDEADYYCSSYTSSGTVVFGGGTKVTVLG

SEQ ID NO: 1526 - protein, 253 aa, Homo sapiens
QVQLVQSGAEVKKPGASVTVSCKASGYSFTDYYIHWVRQAPGQGLEWMGWINPNSGATNHAQRFQGRVTMTRDTSISTAYMDVSGLKSDDTAVYYCARDRRRDDLTGYLYDAFDSWGQGTLVTVSSGGGGSGGGGSGGGGSALSSELTQDPAVSVALGQTVKITCQGDSLRSYYASWYQQKPGQAPVLVIYGRNNRPSGIPDRFSGSSSGNTASLTITGAQAEDEADYYCNSRDSSGYHLVVFGGGTKVTVLG

SEQ ID NO: 1527 - protein, 247 aa, Homo sapiens
QITLKEFGGGLVQPGGSLRLSCGSSGFTFPEHSMDWVRQSPGKGLEWIARSRNRHVSHSTDYAASVKGRFTVSRDFLTNSLILQLNDLKTEDTARYYCASGYDTAMQYWGRGTLVTVSSGGGGSGGGGSGGGGSALSYVLTQPPSASGTPGQRVTISCSGSSSNIGSNTVNWYQQLPGTAPKLLIYSDNRRPSGVPDRFSGSKSGTSASLAISGLQSEDEADYYCAAWDDSLNGYVFGTGTKVTVLG

SEQ ID NO: 1528 - protein, 245 aa, Homo sapiens
QVQLVQSGAEVKKPGSSVKVSCKASGGTVSSRTISWVRQAPGQGLEWMGGSLPPSGAPIYAQKFQGRVAITADALTNTAFMELRSLKSDDTAVYYCARDQGRYLDLWGQGTLVTVSSGGGGSGGGGSGGGGSAQSVVTQPPSASGTPGQRVTISCSGSTSNIGSSSVIWYQRLPGTAPKLLIFYNNQRPSGVPDRFSGSKSGTSASLAINGLQSEDEADYYCATWDTSLNGHVVFGGGTKLTVLG

SEQ ID NO: 1529 - protein, 250 aa, Homo sapiens
EVQLVQSGAEVKKPGASVKVSCKASGYTFSSGGISWVRQAPGQGLEWLGWISAFNGQTNYAQKVQGRLTMTTDTSTSTASMELRSLTSDDTAVYYCARDRRDILTGSNFGQDWGRGTLVTVSSGGGGSGGGGSGGGGSAQSVLTQPPSASGTPGQRVTISCSGGSANIGSNYVYWYKQLPGTAPKTLIYTTNQRPSGVPDRFSGSKSGTSASLAISGLRSEDEGDYYCASWDESLSGVVFGGGTKLTVLG

SEQ ID NO: 1530 - protein, 253 aa, Homo sapiens
QVQLVQSGAEVKKPGASVKVSCKASGYTFTNYGIHWVRQAPGQGLEWLGWISAYNGNTYYSQKLQDRVTLTTDTSTSTAYMELRSLRSDDTAVYYCARMGHYDILTGYRHYGMDVWGRGTLVTVSSGGGGSGGGGSGGGGSALSSELTQDPAVSVALGQTVTITCQGDSLKSYYASWYQQKPGQAPVLVVYNKNSRPSGIPDRFSGSSSGNTASLTITGTQAEDEADYYCNARDRSGIHSVVFGGGTKLTVLG

SEQ ID NO: 1531 - protein, 257 aa, Homo sapiens
KVQLVQSGADVKKPGASVKVSCKASGYNFMNYDINWVRQAPGEGLEWMGWMNPKSGKTDSAEKFEGRVTMTTDTSRDTVYMELSRLRSDDTAVYFCARGSGYDLLTGYFTGSPLDYWGQGTMVTVSSGGGGSGGGGSGGGGSALNFMLTQPHSVSESPGKTVTISCTRSSGYIVSNYVQWYQQRPGSSPTTVIYEDDRRPSGVPHRFSGSIDRSSNSASLTISGLQTEDEGDYYCQSYDKTSRVILFGGGTKVTVLG

SEQ ID NO: 1532 - protein, 245 aa, Homo sapiens
EVQLVQSGAEVKKPGSSVKVSCKASGGTVSSRTISWVRQAPGQGLEWMGGSLPPSGAPIYAQKFQGRVAITADALTNTAFMELRSLKSDDTAVYYCARDQGRYLDLWGKGTLVTVSSGGGGSGGGGSGGGGSAQAVLTQPSSVSGAPGQSVSVSCTGSISNIGTGYDVHWYQHLPGRGPKVLIYGNNDRPWGVPDRFSGSRSGTSASLAITGLQAEDEGDYFCQTYDNELSGYVFGSGTKLTVLG

SEQ ID NO: 1533 - protein, 243 aa, Homo sapiens
QVQLVQSGAEVKKPGSSVKVSCKASGGTVSSRTISWVRQAPGQGLEWMGGSLPPSGAPIYAQKFQGRVAITADALTNTAFMELRSLKSDDTAVYYCARDQGRYLDLWGRGTLVTVSSGGGGSGGGGSGGGGSALSYELTQPPSVSVSAGQTARITCSGDVLSKKYVYWYRQKSGQAPVLVIYENTKRPSGIPDRLSGSRSGTMATLTVTGAQVGDEADYYCHSTYISNDQWVFGGGTKLTVLG

SEQ ID NO: 1534 - protein, 252 aa, Homo sapiens
EVQLVQSGGEVKKPGASVKVSCKASGYSFSSHGISWVRQAPGQGLEWVGWSSAHDDNTKYAQKFQGRVTMTTDASTSTAYMELRSLRSDDTAVYYCARPYYDPLTAYTFQYFGNWGRGTLVTVSSGGGGSGGGGSGGGGSALETTLTQSPGTLSLSPGERATLSCRASQSVSSSYLAWYQQKPGQAPRLLIYGASRRATGIPDRFSGSGSGTDFSLTISRLEPEDFAVYYCQQYGISPGLSFGGGTKVEIKR

SEQ ID NO: 1535 - protein, 250 aa, Homo sapiens
QVQLVQSGAEVKKPGSSVKVSCRASGGSFNHAISWVRQAPGRGLEWMGGILPMYGTANYAQKFQGRVTITADKLTNTVYMDLSRLRYEDTAVYYCARELGLSIVGATTGALDMWGRGTLVTVSSGGGGSGGGGSGGGGSALSSELTQDPAVSVALGQTVRITCQGDSLRSYYASWYQQRPGQAPALVFYGKNNRPSGIPDRFSGSSSGNTASLTITGAQAEDEADYYCNSRDLDGNHRVFGGGTKLTVLG

SEQ ID NO: 1536 - protein, 251 aa, Homo sapiens
EVQLVESGTEVKKPGSAVKVSCKASGGTFSSRGVSWVRQAPGQGLEWMGGIGPMSGTPNYAQKFQGRVTMTADESTSTAYLELSNLRSEDTAVYYCATGRYYDMLTRGGYFDYWGQGTLVTVSSGGGGSGGGGSGGGGSAQSVLTQPPSASGTPGQRITISCSGSRSNIGRNTVTWYQQLPGTAPKLLIYSTNQRPSGVPDRFSGSKSGTSASLAISGLQSDDEADYFCAAWDDSLQALVFGGGTKLTVLG

SEQ ID NO: 1537 - protein, 252 aa, Homo sapiens
QVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARLDYDILTGYYPSGFDYWGQGTMVTVSSGGGGSGGGGSGGGGSAQAVLTQPSSVSGTPGQRVTISCSGSSSDIGRNTVNWYRQVPGTAPKLLIHTINQRPSGVPDRFSGSKSGTSASLAISGLQSEDEADYYCSSWDDSLNAWVFGGGTKLTVLG

SEQ ID NO: 1538 - protein, 251 aa, Homo sapiens
QVQLQESGPGLVQPSQTLSLTCNVSGGSISSNSDYWGWIRQPPGKGLEWIGNVYHTGTTFYTPSLRSRVTISVDTSKNQFSLQVASVTGADTAVYYCARRFYDLLTGYSAFDSWGQGTLVTVSSGGGGSGGGGSGGGGSAQSVLTQPPSVSAAPGQKVAISCSGSNSNIGNNYVSWYQQLPGTAPKLLIYDSIRRPSGIPDRFSGSKSGTSATLGITGLQTGDEADYYCGTWDTSLNAYVFGAGTKLTVLG

SEQ ID NO: 1539 - protein, 255 aa, Homo sapiens
QVQLVESGAEVKKPGASVKVSCEASAELFASSDINWVRRATGQGLEWMGWVNPSSGNAGYAEKFEGRVSMTTNIPKKTVYMELSSLTSEDTAVYYCARGTGYDILTGYYMGSAFDQWGKGTLVTVSSGGGGSGGGGSGGGGSAQSVLTQPPSVSGAPGQRVTISCTGISSNIGAGYAVNWYQQLPGAAPRLLIYGNVNRPSGVPDRFSGSKSGTSASLAITGLQAEDEADYYCQSYDSRLSGSVFGGGTKLTVLG

SEQ ID NO: 1540 - protein, 250 aa, Homo sapiens
QVQLVQSGAEVKKPGSSVKVSCRASGGSFNHAISWVRQAPGRGLEWMGGILPMYGTANYAQKFQGRVTITADKLTNTVYMDLSRLRYEDTAVYYCARELGLSIVGATTGALDMWGQGTMVTVSSGGGGSGGGGSGGGGSALSYVLTQPPSVSVAPGQTASINCGGNTIGSKTVQWYQQKPGQAPVVVVYDDNKRPSGIPERFSGSKSGTSASLAISGLQSDDGADYYCAAWDDSLNGVVFGGGTQLTVLS

SEQ ID NO: 1541 - protein, 252 aa, Homo sapiens
QVQLVQSGAEVKKPGASVKVSCEASAELFASSDINWVRRATGQGLEWMGWVNPSSGNAGYAEKFEGRVSMTTNIPKKTVYMELSSLTSEDTAVYYCARGTGYDILTGYYMGSAFDQWGRGTLVTVSSGGGGSGGGGSGGGGSALSSELTQDPAVSVALGQTVRITCQGDSLRNSYVSWYQQKPGQAPVPVIYTKNNRPSGIPERFSGSSSGNTASLTITGAQAEDEADYYCASRDRSGHGVFGGGTKLTVLG

SEQ ID NO: 1542 - protein, 251 aa, Homo sapiens
QVQLVQSGGGVVRPGGSLRLSCAASGFTFGDYGMSWVRQAPGKGLEWVSGIIWNGGTTDYADTVKGRFTISRDNAKNSLYLQMNSLRVEDTALYYCAREYYDVLTGLFYYMDVWGQGTLVTVSSGGGGSGGGGSGGGGSAQPVLTQPPSASGTPGQRVTISCSGSSSNIGSNTVNWYQQLPGTAPELLIYSNNQRPSGVPDRFSGSKSGTSASLAISGLQSEDEADYYCAAYDDSLNGWVFGGGTKLTVLG

SEQ ID NO: 1543 - protein, 253 aa, Homo sapiens
EVQLVQSGTEVKKPGASVKVSCKTSGYSFDNYGIAWLRQAPGQGLEWMGWISAYDGDRNYAQKLRGRVTMTTDTSTSTAYMELRSLRPDDTAVYYCARDDRDILTNYYLEYFQHWGRGTLVTVSSGGGGSGGGGSGGGGSAQAVLTQPSSVSGAPGQRVTISCTGSTSNIGAGYDVHWYQQLPGRAPKLLIYANSKRPSGVPDRFTASKSGTTASLAITGLQTDDEAGYYCQAYDKNIEEYVFGSGTQLTVLS

SEQ ID NO: 1544 - protein, 254 aa, Homo sapiens
QVQLVQSGAEVKKPGASVKVSCEASAELFASSDINWVRQATGQGLEWMGWVNPSSGNAGYAEKFEGRVSMTTNIPKKTVYMELSSLTSEDTAVYYCARGTGYDILTGYYMGSAFDQWGRGTLVTVSSGGGGSGGGGSGGGGSAQSVVTQPPSASGSPGQSVTISCTGTSSDVGRYNYVSWYQQHPGRAPKLMIYEVNKRPSGVPDRFSGSKSGNTASLTVSGLQAEDEANYYCSSYAGSNIEVFGGGTKLTVLG

SEQ ID NO: 1545 - protein, 253 aa, Homo sapiens
EVQLVQSGAEVKKPGASVKVSCEASAELFASSDINWVRQATGQGLEWMGWVNPSSGNAGYAEKFEGRVSMTTNIPKKTVYMELSSLTSEDTAVYYCARGTGYDILTGYYMGSAFDQWGRGTLVTVSSGGGGSGGGGSGGGGSAQSVLTQPPSVSAASGQRVTIPCSGSSSNIGIGSVSWYQQFPGSAPKFLISGNKRPSGIPDRFSVSKSGTSATLDITGLQTGDEADYYCGTWDTTLNAWVFGAGTKLTVLG

SEQ ID NO: 1546 - protein, 251 aa, Homo sapiens
QVQLQESGPGLVKPSGTLSLTCAVSGDSIRGGHWWNWVRQPPGKGLEWIGEVYHSGSTNSNPSLKSRVTLSADKSKNLFSLSLSSVTAADTAVYYCARGDYDVLTGYLRKLDYWGKGTLVTVSSGGGGSGGGGSGGGGSAQPVLTQPPSASGTPGQRVTISCSGSSSNIGSRTVNWYQQLPGTAPKLLVYSTNLRPSGVPDRFSGSKSGTSASLAISGLQSEDEADYYCSAWDDSLNGPVFGGGTKVTVLG

SEQ ID NO: 1547 - protein, 245 aa, Homo sapiens
QVQLVQSGAEVKKPGSSVKVSCKASGGTVSSRTISWVRQAPGQGLEWMGGSLPPSGAPIYAQKFQGRVAITADALTNTAFMELRSLKSDDTAVYYCARDQGRYLDLWGRGTLVTVSSGGGGSGGGGSGGGGSALSYVLTQPPSASVTPGQRVTISCSGGSTNIGSTYVNWYQHLPGTAPKLLMYNNNERPSGVPDRFSGSKSGTSASLAITGVRSGDEADYYCAAWDDSLNGPVFGGGTKLTVLG

SEQ ID NO: 1548 - protein, 250 aa, Homo sapiens
QVQLQESGPGLVKPSETLSLTCAVSGYSISSGYYWGWIRQPPGKGLEWIGSIYHSGSTYYNPSLKSRVTISVDTSKNQFSLKLSSVTAADTAVYYCARVHYDILTGYLWAFDIWGQGTMVTVSSGGGGSGGGGSGGGGSALSSELTQDPAVSVALGQTVRITCQGDSLRSYYASWYQQKPGQAPVLVIYGKNNRPSGIPDRFSGSSSGNTASLTITGTQAEDEADYYCNSRDSSGNHVVFGGGTQLTVLS

SEQ ID NO: 1549 - protein, 252 aa, Homo sapiens
QVQLVQSGAEVKKPGSSVKVSCRASGGSFNHAISWVRQAPGRGLEWMGGILPMYGTANYAQKFQGRVTITADKLTNTVYMDLSRLRYEDTAVYYCARELGLSIVGATTGALDMWGQGTMVTVSSGGGGSGGGGSGGGGSAQSVLTQPPSVSAAPGQSVTISCSGSISNIGNNYVSWYQHFPGTAPKLLIYDKNQRPSGIPDRFSGSKSGTSATLVITGLQTEDEADYYCGTWDSSLSHSAVFGGGTKLTVLG

SEQ ID NO: 1550 - protein, 245 aa, Homo sapiens
EVQLVQSGAEVKKPGSSVKVSCKASGGTVSSRTISWVRQAPGQGLEWMGGSLPPSGAPIYAQKFQGRVAITADALTNTAFMELRSLKSDDTAVYYCARDQGRYLDLWGRGTLVTVSSGGGGSGGGGSGGGGSAQAVLTQPSSASGTPGQRVTISCSGTNSNIGSNYVYWYRHLPGTAPELLIYNNNRRPSGVPDRFSGSKSGTSASLAIRGLRSDDEADYYCAAWDDSLSVYYVFGTGTKLTVLG

SEQ ID NO: 1551 - protein, 251 aa, Homo sapiens
QVQLVQSGTEVKKPGSAVKVSCKASGGTFSSRGVSWVRQAPGQGLEWMGGIGPMSGTPNYAQKFQGRVTMTADESTSTAYLELSNLRSEDTAVYYCATGRYYDMLTRGGYFDYWGRGTMVTVSSGGGGSGGGGSGGGGSAQSVVTQPPSVSAAPGQKVTISCSGSSSNIGSNYVSWYRQLPGTAPKLLIYDSNKRPSGIPDRFSGSKSGSSATLGITGLQTGDEADYYCGTWDSGLSAVVFGGGTKVTVLG

SEQ ID NO: 1552 - protein, 259 aa, Homo sapiens
EVQLVQSGAEVKKPGASVKVSCEASAELFASSDINWVRRATGQGLEWMGWVNPSSGNAGYAEKFEGRVSMTTNIPKKTVYMELSSLTSEDTAVYYCARGTGYDILTGYYMGSAFDQWGKGTMVTVSSGGGGSGGGGSGGGGSAQAVLTQPSSLSASPGASASLTCTLRSDINLETSRIYWFQQKPGSPPRYLLRYQSDSDNNLDSGVPSRFSGSKDASANAGILLISGVQSEDEADYHCMIWHSGGSVFGGGTQLTVLT

SEQ ID NO: 1553 - protein, 257 aa, Homo sapiens
QVQLQQSGAEVKKPGSSVKVSCKASGGTFSSYAISWVRQAPGQGLEWMGGIIPIFGTANYAQKFQGRVTITADKSTSTAYMELSSLRSEDTAVYYCARNGYYDILTGYYLWDYYYGMDVWGQGTLVTVSSGGGGSGGGGSGGGGSAQSVLTQPPSASGTPGQRVTISCSGSSSNIGSNIVHWYQQFPGSAPKLLINSNYLRPSGVPDRFSGSKSGTSASLAISGLQSEDEADYYCASWDDSLNGWVFGGGTKVTVLG

SEQ ID NO: 1554 - protein, 251 aa, Homo sapiens
QVQLQESGGGVVQPGRSLRLSCAASEFTFSNYAMHWVRQAPGKGLEWVAVISYDGTYKSYADSMKGRFTISRDNSKNSLYLQMNSLRAEDTAVYYCARENYDSLTGYYNYFDYWGQGTLVTVSSGGGGSGGGGSGGGGSAQAVLTQPSSDSGTPGQRVTISWSGSGSNIGSNAVSWYQQLPGTASKLLIYSNNLRPSGVPDRFSGSKSATSAALAISGLQSEDEADYYCAAWDDTLNAEVFGGGTKVTVLG

SEQ ID NO: 1555 - protein, 251 aa, Homo sapiens
QVQLVPSGAEVKKPGASVKVSCKASGYTFTSYGISWVRQAPGQGLEWMGWISAYNGNTNYAQKLQGRVTMTTDTSTSTAYMELRSLRSDDTAVYYCARTHYDILTGYYSHPLDYWGKGTLVTVSSGGGGSGGGGSGGGGSALSSELTQDPAVSVALGQTVTITCQGDSLRTYPTTWYQQRPRQAPVAVISGKNYRPSGIPDRFSGSTSGDTASLTITGAQAEDEADYYCMSRDSSGTFVLFGGGTKVTVLS

SEQ ID NO: 1556 - protein, 251 aa, Homo sapiens
EVQLVQSGAEVKKPGSSVKVSCRASGGSFNHAISWVRQAPGRGLEWMGGILPMYGTANYAQKFQGRVTITADKLTNTVYMDLSRLRYEDTAVYYCARELGLSIVGATTGALDMWGRGTLVTVSSGGGGSGGGGSGGGGSAQSVVTQPPAVSAAPGQKVTISCSGSSSNIGSYYVSWYQQLPGTAPKLLIYDNDKRPSGIPDRFSVSKSGTSSTLAITGLQTGDEADYYCGTWDSSLSAGVFGGGTKVTVLG

SEQ ID NO: 1557 - protein, 252 aa, Homo sapiens
QVQLVQSGAEVKRPGASVKVSCKASGYTFISYGMNWVRQAPGQGLEWMGRISIYEDKVKYAEKFQGRLTMTTDTSTSTAYMELTSLRSDDTAVYYCARVPYDILTGYWGAFDVWGRGTLVTVSSGGGGSGGGGSGGGGSAQSVLTQPPSVSGAPGQRVTISCTGSSSNTGAGYDVHWYKQLPRTAPQLLIYRNNNRPSGVPDRFSGSKSGTSASLAITGLQAEDEAEYYCQSYDTSLSGSVFGGGTKVTVLG

SEQ ID NO: 1558 - protein, 256 aa, Homo sapiens
QVQLVQSGADVKKPGASVKVSCKASGYNFMNYDINWVRQAPGEGLEWMGWMNPKSGKTDSAEKFEGRVTMTTDTSRDTVYMELSRLRSDDTAVYFCARGSGYDLLTGYFTGSPLDYWGQGTLVTVSSGGGGSGGGGSGGGGSAQSVLTQPPSASGSPGQSVTISCTGTSNDVSAYKYVSWYQQYPGRAPKLILYEVTKRPSGVPDRFSGSKSGNTASLTVSGLQADDEATYFCSSFAGSNNFAGVFGGGTKLTVLG

SEQ ID NO: 1559 - protein, 256 aa, Homo sapiens
QVQLVQSGADVKKPGASVKVSCKASGYNFMNYDINWVRQAPGEGLEWMGWMNPKSGKTDSAEKFEGRVTMTTDTSRDTVYMELSRLRSDDTAVYFCARGSGYDLLTGYFTGSPLDYWGQGTLVTVSSGGGGSGGGGSGGGGSAQSVLTQPPSASGSPGQSVAISCTGTSNDVSAYKYVSWYQQYPGRAPKLILYEVTNRPSGVIDRFSGCKSANTASLTVSGLQPDDEDTYFCSSFAGSSSFAGVFGGGTKLTVLG

SEQ ID NO: 1560 - protein, 250 aa, Homo sapiens
QVQLLQSAAEVKKPGASVKVSCKASGYTFTSYGISWVRQAPGQGLEWMGWISAYNGNTNYAQKLQGRVTMTTDTSTSTAYMELRSLRSDDTAVYYCARVYYDILTGYNLFFDYWGKGTLVTVSSGGGGSGGGGSGGGGSQSVLTQPPSVSGPPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1561 - protein, 250 aa, Homo sapiens
QVQLQQSGAEVKKPGASVKVSCKASGYTFTSYGISWVRQAPGQGLEWMGWISAYNGNTNYAQKLQGRVTMTTDTSTSTAYMELRSLRSDDTAVYYCARVYYDILTGYNLFFDYWGKGTMVTVSSGGGGSGGGGSGGGGSQSVLTQPASVSGSPGQSITISCTGTSSDVGGYNYVSWHQQHPGKAPKLMIYEGSKRPSGVSNRFSGSKSGNTASLTISGLQAEDEADYYCSSYTTRSTRVFGGGTKLTVLG

SEQ ID NO: 1562 - protein, 251 aa, Homo sapiens
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARMEYDILTGYYGGYFDYWGQGTTVTVSSGGGGSGGGGSGGGGSQSVLTQPASVSGSPGQSITISCTGTSSDVGGYNYVSWYQQHPGKAPKLMIYEGSKRPSGVSNRFSGSKPGNTASLTISGLQAEDEADYYCSSYTTRSTRVFGGGTKLTVLG

SEQ ID NO: 1563 - protein, 250 aa, Homo sapiens
QVQLVQSGAEVKKPGSSVKVSCRASGGSFNKHAISWVRQAPGRGLEWMGGILPMYGTANYAQKFQGRVTITADKLTNTVYMDLSRLRYEDTAVYYCARELGLSIVGATTGALDMWGKGTLVTVSSGGGGSGGGGSGGGGSALPVLTQPPSVSVAPGQTATLTCGGTNFGRQSVHWYQQKPGQAPVLAIYHDDVRPSGIPERLSGSKSGNTATLTISRVEAGDEAAYYCQVWDSGSDVVVFGGGTKLTVLG

SEQ ID NO: 1564 - protein, 250 aa, Homo sapiens
QVQLVQSGAEVKKPGSSVKVSCRASGGSFNRHAISWVRQAPGRGLEWMGGILPMYGTANYAQKFQGRVTITADKLTNTVYMDLSRLRYEDTAVYYCARELGLSIVGATTGALDMWGKGTLVTVSSGGGGSGGGGSGGGGSALPVLTQPPSVSVAPGQTATLTCGGTNFGRQSVHWYQQKPGQAPVLAIYHDDVRPSGIPERLSGSKSGNTATLTISRVEAGDEAAYYCQVWDSGSDVVVFGGGTKLTVLG

SEQ ID NO: 1565 - protein, 250 aa, Homo sapiens
QVQLVQSGAEVKKPGSSVKVSCRASGGSFNKHAISWVRQAPGRGLEWMGGILPMYGTANYAQKFQGRVTITADKLTNTVYMDLSRLRYEDTAVYYCARELGLSIVGATTGALDMWGKGTLVTVSSGGGGSGGGGSGGGGSAQSVLTQPPSVSAAPGQKVTISCSGSSSNIGNNYVSWYQQIPGTAPKLLIYENNKRPSGIPDRFSGSKSGASATLDITGLQTGDEADYYCGTWHSSQVVFGGGTKLTVLG

SEQ ID NO: 1566 - protein, 250 aa, Homo sapiens
QVQLVQSGAEVKKPGSSVKVSCRASGGSFNRHAISWVRQAPGRGLEWMGGILPMYGTANYAQKFQGRVTITADKLTNTVYMDLSRLRYEDTAVYYCARELGLSIVGATTGALDMWGKGTLVTVSSGGGGSGGGGSGGGGSAQSVLTQPPSVSAAPGQKVTISCSGSSSNIGNNYVSWYQQIPGTAPKLLIYENNKRPSGIPDRFSGSKSGASATLDITGLQTGDEADYYCGTWHSSQVVFGGGTKLTVLG

SEQ ID NO: 1567 - protein, 259 aa, Homo sapiens
QMQLVQSGAEVKKPGASVKVSCKASGYTFTSYYMHWVRQAPGQGLEWMGWINAGNSNTKYSQKFQGRVTITSDTSASTAYMELSGLRSEDTAVYYCARDRGAPNYDILTGYYAPAQGVAFDIWGKGTLATVSSGGGGSGGGGSGGGGSQSVLTQPPSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLG

SEQ ID NO: 1568 - protein, 244 aa, Homo sapiens
EVQLVQSGAEVKKPGSSVKVSCKASGGTVSSRTISWVRQAPGQGLEWMGGSLPPSGAPIYAQKFQGRVAITADALTNTAFMELRSLKSDDTAVYYCARDQGRYLDLWGKGTLVTVSSGGGGSGGGGSGGGGSAQAVLTQPSSVSGAPGQRVTISCTGSRSNIGAGYDVHWYQQLPGTAPKLLIYGNSNRPSGVPDRFSGSKSGTSASLAITGLQADDEADYYCQSYDTSLRGLFGTGTKVTVLG

SEQ ID NO: 1569 - protein, 244 aa, Homo sapiens
QVQLVQSGAEVKKPGSSVKVSCKASGGTVSSRTISWVRQAPGQGLEWMGGSLPPSGAPIYAQKFQGRVAITADALTNTAFMELRSLKSDDTAVYYCARDQGRYLDLWGQGTMVTVSSGGGGSGGGGSGGGGSAQAVLTQPSSASGTPGQRATISCSGSSSDIGINAVNWYKQLPRTAPKLLIYRNNQRPSGVPDRFSGSKSGTSASLAIIGLQSEDEADYYCATWDDSLTAYVFGTGTKVTVLG

SEQ ID NO: 1570 - protein, 249 aa, Homo sapiens
QVQLVQSGAEVKKPGSSVKVSCRASGGSFNHAISWVRQAPGRGLEWMGGILPMYGTANYAQKFQGRVTITADKLTNTVYMDLSRLRYEDTAVYYCARELGLSIVGATTGALDMWGKGTLVTVSSGGGGSGGGGSGGGGSALPVLTQPPSVSVAPGQTATLTCGGTNFGRQSVHWYQQKPGQAPVLAIYHDDVRPSGIPERLSGSKSGNTATLTISRVEAGDEAAYYCQVWDSGSDVVVFGGGTKLTVLG

SEQ ID NO: 1571 - protein, 249 aa, Homo sapiens
QVQLVQSGAEVKKPGSSVKVSCRASGGSFNHAISWVRQAPGRGLEWMGGILPMYGTANYAQKFQGRVTITADKLTNTVYMDLSRLRYEDTAVYYCARELGLSIVGATTGALDMWGKGTLVTVSSGGGGSGGGGSGGGGSAQSVLTQPPSVSAAPGQKVTISCSGSSSNIGNNYVSWYQQIPGTAPKLLIYENNKRPSGIPDRFSGSKSGASAALDITGLQTGDEADYYCGTWHSSQVVFGGGTKLTVLG

SEQ ID NO: 1572 - protein, 249 aa, Homo sapiens
QVHLVQSGAEVKKPGSSVKVSCRASGGSFNHAISWVRQAPGRGLEWMGGILPMYGTANYAQKFQGRVTITADKLTNTVYMDLSRLRYEDTAVYYCARELGLSIVGATTGALDMWGKGTLVTVSSGGGGSGGGGSGGGGSAQSVLTQPPSVSAAPGQKVTISCSGSSSNIGNNYVSWYQQIPGTAPKLLIYENNKRPSGIPDRFSGSKSGASATLDITGLQTGDEADYYCGTWHSSQVVFGGGTKLTVLG

SEQ ID NO: 1573 - protein, 249 aa, Homo sapiens
QVQLVQSGAEVKKPGSSVKVSCRASGGSFNHAISWVRQAPGRGLEWMGGILPMYGTANYAQKFQGRVTITADKLTNTVYMDLSRLRYEDTAVYYCARELGLSIVGATTGALDMWGKGTLVTVSSGGGGSGGGGSGGGGSAQSVLTQPPSVSAAPGQKVTISCSGSSSNIGNNYVSWYQQIPGTAPKLLIYENNKRPSGIPDRFSGSKSGASATLDITGLQTGDEADYYCGTWHSSQVVFGGGTKLTVLG

SEQ ID NO: 1574 - protein, 250 aa, Homo sapiens
QVQLVQSGAEVKKPGSSVKVSCRASGGSFNHAISWVRQAPGRGLEVDGRDPPYVWYSKLCTEVPRAESRSPRTTLTNTVYMDLSRLRYEDTAVYYCARELGLSIVGATTGALDMWGKGTLVTVSSGGGGSGGGGSGGGGSALPVLTQPPSVSVAPGQTATLTCGGTNFGRQSVHWYQQKPGQAPVLAIYHDDVRPSGIPERLSGSKSGNTATLTISRVEAGDEAAYYCQVWDSGSDVVVFGGGTKLTVLG

SEQ ID NO: 1575 - protein, 252 aa, Homo sapiens
QVQLVQSGAEVKKPGSSVKVSCRASGGSFNHAISWVRQAPGRGLEWMGGILPMYGTANYAQKFQGRVTITADKLTNTVYMDLSRLRYEDTAVYYCARELGLSIVGATTGALDMWGRGTLVTVSSGGGGSGGGGSGGGGSAQAVLTQPSSVSGAPGQRVIISCTGSSSNIGPDYDVHWYQQLPGTAPKLLIYGNNNRPSGVPDRFSGSKSGTSASLAITGLQAEDEAHYYCQSYGSSLSGVVFGGGTKVTVLG

SEQ ID NO: 1576 - protein, 257 aa, Homo sapiens
QVQLVQSGAEVKKPGASVKVSCEASGYTFTSYGISWVRQAPGQGLEWMGWISTYNGNTRYPQKLQGRVTMTTDTSTSTAYMDLRSLRSDDTAVYYCARDGRLSYDILTGYYARDYYGMDDWGRGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1577 - protein, 241 aa, Homo sapiens
QVQLVQSGAEVKKPGSSVKVSCKASGGTFSSYAISWVRQAPGQGLEWMGGIIPIFGTANYAQKFQGRVTITADDLTRTAYMEMSSLKFEDTAVYYCASSEGTIFGVDWGRGTLVTVSSGGGGSGGGGSGGGGSDIQMTQSPSFLSASVGDRVTITCRASQGINNYLAWYQQKPGRAPKLLMYAASSLQSGVPSRFSGSGSGTDFTLTISSLQPEDFATYYCLQDSDYPLTFGGGTKLEIKR

SEQ ID NO: 1578 - protein, 254 aa, Homo sapiens
QVQLQESGPGLVKPSETLSLTCTVSGGSISSGYYWGWVRQPPGQGLEWIGSIYHSGSTYHNPSLKSRVTISMDTSKNQFSLNLNSVTAADTAVYYCARGKGYYDILTGYYRDNWFDPWGRGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1579 - protein, 257 aa, Homo sapiens
GVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARTPSSVYDLLTGYYHYFYSYMDVWGRGTMVTVSSGGGGSGGGGSGGGGSQSVLTQPASVSGSPGQSITISCTGTSSDVGGYNYVSWYQQHPGEAPKLMIYEGSKRPSGVSNRFSGSKSGNTASLTISGLQAEDEADYYCSSYTTRSTRVFGGGTKLTVLG

SEQ ID NO: 1580 - protein, 242 aa, Homo sapiens
QVQLQQSGAEVKKPGSSVKVSCKASGDTFSSFGISWVRQVPGQGLEWMGAIIPKFDIVTYAEEFKGRVTISADKLTNTAYMEVKSLRSEDTAVYYCTREKSAAGYFDYWGKGTLVTVSSGGGGSGGGGSGGGGSDIVMTQSPSTLSASVGDRVTITCRASQGISSWLAWYQQKPGRAPKVLIYKASTLESGVPSRFSGSGSGTDFTLTISSLQPEDFATYYCQQSYSTPWTFGQGTKLEIKR

SEQ ID NO: 1581 - protein, 250 aa, Homo sapiens
QVQLQQSGAEVKKPGSSVKVSCKASGGTFSSYAISWVRQAPGQGLEWMGRIIPIVNMANYAQKFQGRVTLTADKSTGTAYMELTSLRSEDTAVYYCARENYDSLTGYYGAFDIWGKGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1582 - protein, 244 aa, Homo sapiens
QVQLVQSGAEVKKPGSSVKVSCKASGGTVSSRTISWVRQAPGQGLEWMGGSLPPSGAPIYAQKFQGRVAITADALTNTAFMELRSLKSDDTAVYYCARDQGRYLDLWGRGTLVTVSSGGGGSGGGGSGGGGSALPVLTQPPSASATPGQRVTISCSGSSSNIGSNYVYWYQQLPGTAPKVLIYRNNQRPSGVPDRFSGSRSGTSASLAISGLRSEDEADYYCATWDDSLSGPVFGGGTKVTVLG

SEQ ID NO: 1583 - protein, 252 aa, Homo sapiens
QVQLVQSGAEVKKPGSSVKVSCRASGGSFNHAIICWRQAPARQLEGMIGILIMYGTADYAQKFQGRVTITADNLTNTAYMDLSSLRYEDTAVYYCARKLGLSIVGATTGALDMWGQGTLVTVSSGGGGSGGGGSGGGGSAQSVLTQPASASGSPGQRVTISCSGSSSNIGSNTVIWWQQLPAAAANLLMYSNNRRPSGVLERFSGCKYGASASLAISGLQQEDEDVIITVQHGMPALKGWVFGGGTKVTVLG

SEQ ID NO: 1584 - protein, 254 aa, Homo sapiens
QVQLQQSGAEVKKPGSSVKVSCQASGGSFSREGISWVRQAPGHGLEWMGRIIPVLGVADYAQKFQGRVKISVDRLTSVAYMELTSLRFEDTAVYYCAREGMNDFINSHHYYTMDAWGQGTLVTVSSGGGGSGGGGSGGGGSAQAVLTQPSSVSGAPGQRVTISCTGSSSNIGAGYDVHWYQQLPGTAPKLLIYGNSNRPSGVPDRFSGSKSGTSASLAITGLQAEDEADYYCQSYDSSLSGSVFGGGTKLTVLG

SEQ ID NO: 1585 - protein, 251 aa, Homo sapiens
EVQLVQSGADVKKPGASVKVSCKASHYPFTTYGVSWVRQAPGQGLEWMGWISNYNGHTRYAPKFQGRVTLTTDTLTNTAFMELKSLTSDDTAIYYCARAGNEYGHTERPADYWGKGTMVTVSSGGGGSGGGGSGGGGSAQAVLTQPSSVSGAPGQRVTISCTGSSSNIGAGYDVHWYQQLPGTTPKLLISRNNNRPPGVPDRFSGSKSGTSASLAITGLQAEDEADYYCQSYDTTLRGWVFGGGTKVTVLG

SEQ ID NO: 1586 - protein, 251 aa, Homo sapiens
QVQLVQSGAEVKKPGASVKVSCKASGYTFTSYGISWVRQAPGQGLEWMGWISAYNGNTNYAQKLQGRVTMTTDTSTSTAYMELRSLRSEDTAVYYCARMEYDILTGYYGGYFDYWGQGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1587 - protein, 251 aa, Homo sapiens
QVQLQQSGAEVKKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGQGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLD

SEQ ID NO: 1588 - protein, 248 aa, Homo sapiens
QVQLQQSGAEVKKPGASVKVSCRASGYTFTKYTMHWVRQAPGQGPEWMGWINGGSGDTKYSRKFQGRVTITKDTSASAAYMELSSLGSEDTALYYCARATYDPLTGYSFDGFDIWGQGTLVTVSSGGGGSGGGGSGGGGSSELTQDPAVSVALGQTVRITCQGDSLRSYYTNWFQQKPGQAPLLVVYAKNKRPSGIPDRFSGSSSGNTASLTITGAQAEDEADYYCNSRDSSGNHVVFGGGTKLTVLD

SEQ ID NO: 1589 - protein, 246 aa, Homo sapiens
QVQLQQSGAEVKKPGSSVKVSCKASGGTFRSYAFSWVRQAPGQGLEWMGYIVPVFGTATYAQNFQGRVTITADELTTTAFMELSSLTSEDTAVYYCARSLATRPLGMDVWGRGTTVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1590 - protein, 252 aa, Homo sapiens
EVQLVQSGAEVKKPGSSVKVSCRASGGSFNHAISWVRQAPGRGLEWMGGILPMYGTANYAQKFQGRVTITADKLTNTVYMDLSRLRYEDTAVYYCARELGLSIVGATTGALDMWGRGTLVTVSSGGGGSGGGGSGGGGSALSYELTQPPSASGTPGQRVTISCSGSTSNIGSNAVNWYRQLPGTAPKLLVYSNNQVPSGVPDRFSGSKSGTSASLAISGLQSEDEADYYCAAWDDSLSGYVFGTGTQLTVLS

SEQ ID NO: 1591 - protein, 251 aa, Homo sapiens
QVQLVQSGAEVKKPGSSVKVSCRASGGSFNHAISWVRQAPGRGLEWMGGILPMYGTANYAQKFQGRVTITADKLTNTVYMDLSRLRYEDTAVYYCARELGLSIVGATTGALDMWGRGTLVTVSSGGGGSGGGGSGGGGSAQSVVTQPPSASGTPGQRVTVSCSGGRSNIGSNTVSWYQQLPGTAPKLLIYSNDERPSGVPDRFSGSNSGTSASLAISGLQSEDEADYYCAAWDDSLNGVAFGGGTKLTVLG

SEQ ID NO: 1592 - protein, 251 aa, Homo sapiens
QVQLVQSGAEVKKPGASVKVSCKTSGYTFTGYNINWVRQAPGQGLEWMGWVSPSNGDTSYAQTFQGRVTMTRDTSISTAYMELSSLKSDDTAVYYCARDHFDTLTGYFRRLDSWGQGTLVTVSSGGGGSGGGGSGGGGSALSSELTQDPEVSVALGQTVTITCQGDSLITHYASWFQQKPGQAPLLVFYSKDKRPSGIPDRFSGSYSGNTASLTITGAQAEDEADYYCNSRDSRGKNHVAFGGGTKLTVLG

SEQ ID NO: 1593 - protein, 250 aa, Homo sapiens
QVQLQQSGAEVKKPGASVKVSCKASGYTFTSYGISWVRQAPGQGLEWMGWISAYNGNTNYAQKLQGRVTMTTDTSTSTAYMELRSLRSDDTAVYYCARVYYDILTGYNLFFDYWGKGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1594 - protein, 251 aa, Homo sapiens
QVNLRESGGGLVQPGGSLRLSCAASGFTFSSYWMSWVRQAPGKGLEWVANIKQDGSEKYYVDSVKGRFTISRDNSKNTLYLQMNSLRAEDTAVYYCARDAQSYYDILTGYQSYAFDIWGQGTTVTVSSGGGGSGGGGSGGGGSSELTQDPAVSVALGQTVRITCQGDSLRSYYTNWFQQKPGQAPLLVVYAKNKRPSGIPDRFSGSSSGNTASLTITGAQAEDEADYYCHSRDSSGNHVLFGGGTKLTVLG

SEQ ID NO: 1595 - protein, 250 aa, Homo sapiens
QVQLVQSAAEVKKPGASVKVSCKASGYTFTSYGISWVRQAPGQGLEWMGWISAYNGNTNYAQKLQGRVTMTTDTSTSTAYMELRSLRSDDTAVYYCARVYYDILTGYNLFFDYWGRGTTVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1596 - protein, 257 aa, Homo sapiens
QVQLVQSGAEVKKPGSSVKVSCKASGDTFGKYAITWVRQAPGQGLEWMGIINPSGGSTSYAQKFQGRVTMTRDTSTSTVYMELSSLRSEDTAVYYCARGPSTTYYDILTGYYTPYYYYYYMDVWGQGTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1597 - protein, 255 aa, Homo sapiens
QVQLQESGPGLVKSSGTLSLTCSVSGASILEGDYFWTWIRQPPGKGLEWIGEINHRGDINYNPSLKSRVTILVDTSKNQLSLKLNSVTAADTAVYYCARHVRDYDILTGYYRGHYFDYWGKGTLVTVSSGGGGSGGGGSGGGGSQSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLG

SEQ ID NO: 1598 - protein, 250 aa, Homo sapiens
GVQLVQSGAVVKKPGSSVKVSCKASGGTFRNNAFSWVRQAPGQGLEWVGGIIPVFETINTAQKFQGRVTITADELTTTAYMELSSLRVDDTAVYYCATERGVVTAYGGDSFDLWGKGTLVTVSSGGGGSGGGGSGGGGSQSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLS

SEQ ID NO: 1599 - protein, 248 aa, Homo sapiens
QVQLVQSGAEVRKPGSSVKVSCRASGGTFSSYALNWVRQAPGQGLEWMGGIIPIFGTAYYAQKFRGRITITADELTNTAYMELSSLTSDDSAVYYCARDRGPGLLSSFFESWGQGTLVTVSSGGGGSGGGGSGGGGSQSALTQPASVSGSRGQSITISCTGTTGDVGGYDYVSWYQQHPGKAPKLLIYGNSNRPSGVPDRFSASKSGNTASLTISGLQAEDEADYFCSTYAPPGIIMFGGGTKLTVLG

SEQ ID NO: 1600 - protein, 256 aa, Homo sapiens
QVRLQQSGAEVKKPGSSVKVSCKASGGTFSSYAISWVRQAPGQGLEWMGRIIPILGIANYAQKFQGRVTITADKSTSTAYMELSSLRSEDTAVYYCARDEYYDILTGYQAPYYYYGMDVWGQGTLVTVSSGGGGSGGGGSGGGGSQSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLG

SEQ ID NO: 1601 - protein, 250 aa, Homo sapiens
QVQLQQSGAVVKKPGSSVKVSCKASGGTFRNNAFSWVRQAPGQGLEWVGGIIPVFETINTAQKFQGRATITADELTTTAYMELSSLRVDDTAVYYCATERGVVTAYGGDSFDLWGRGTLVTVSSGGGGSGGGGSGGGGSQSVLTQPASVSGSPGQSITISCTGTSSDVGGYNYVSWYQQHPGEAPKLMIYEGSKRPSGVSNRFSGSKSGNTASLTISGLQAEDEADYYCSSYTTRSTRVFGGGTKLTVLG

SEQ ID NO: 1602 - protein, 253 aa, Homo sapiens
EVQLQQWGAGLLKPSETLSLTCAVSGGSISENYWSWIRQPPGKGLEWIGEITHSGNTHYNPSLKSRVSISVDASKNQFSLKLSSVSAADTAVYYCARDVTYHDILTGYAGHEAFDIWGRGTLVTVSSGGGGSGGGGSGGGGSQSVLTQPASVSGSPGQSITISCTGTSSDVGGYNYVSWYQQHPGKAPKLMIYEGSKRPSGASNRFSGSKSGNTASLTISGLQAEDEADYYCSSYTTRSTRVFGGGTKLTVLG

SEQ ID NO: 1603 - protein, 255 aa, Homo sapiens
QVQLQQSGPGLVKPSQTLSLSCAISGDSVGSNGAAWNWIRQSPSRGLEWLGRTYYRSQWYSDYGASVRSRITINADTSKNQFSLQLNSVTPEDTAVYYCARESGRYDILTGYYSGGGGMDVWGRGTLVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKR

SEQ ID NO: 1604 - protein, 256 aa, Homo sapiens
QVTLKESGGGLGQPGRSLRLSCAASGFTFDSYELNWVRQAPGKGLEWLSYISSDGTTKYYADSVKGRFTISRDNAKDSLYLQMNSLRDDDTAVYFCARDGANYDILTGYYTTTVYGMDVWGQGTTVTVSSGGGGSGGGGSGGGGSRSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1605 - protein, 251 aa, Homo sapiens
EVQLVQSGGGLVQPGGSLRLSCAASGFTFSSYAMSWVRQAPGKGQEWVSAISGSGGSTYYADSVKGRFTISRDNSKNTLYLQMNSLRAEDTAVYYCARRSYDILTGYYTYGMDVWGKGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1606 - protein, 244 aa, Homo sapiens
EVQLVQSGAEVKKPGSSVKVSCKASGGTFRSYGISWVRQAPGQGLEWMGGIIPIFGKPNSAQRFKGRVTITADELTTTAYMELSGLTSEDTAVYYCAAEGSSGYLVGWGRGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1607 - protein, 256 aa, Homo sapiens
QVQLQESGSGLVKPSQTLSLTCAVSGGSISSGGYSWSWIRQPPGKGLEWIGYIYHSGSTYYNPSLKSRVTISVDRSKNQFSLKLSSVTAADTAVYYCARKQRGDYDILTGYQLGYAFDIWGRGTPVTVSSGGGGSGGGGSGGGGSQSVLTQPPSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLG

SEQ ID NO: 1608 - protein, 255 aa, Homo sapiens
QVQLVQSGGGLVKPGGSLRLSCAASGFIFSSYTMNWVRQAPGKGLEWVSSISSGSSYIYYADSMKGRFTISRDNAKNSLYLQMNSLRAEDTAVYYCARERPGYDILTGYPSSIYGMDVWGRGTPVTVSSGGGGSGGGGSGGGGSQSVLTQPASVSGSPGQSITISCTGTSSDVGGYNYVSWYQQHPGKAPKLMIYEGGKRPSGVSNRFSGSKSGNTASLTISGLQAEDEADYYCSSYTTRSTRAFGGGTKLTVLG

SEQ ID NO: 1609 - protein, 248 aa, Homo sapiens
QVQLQQSGAEVKKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGQGTMVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1610 - protein, 257 aa, Homo sapiens
QVQLQQSGAEVKKPGASVKVSCKASGYTFTSYGISWVRQAPGQGLEWMGWISAYNGNTKYAQELQGRVTMTTDTSTSTAYMELRSLRSDDTAVYYCARDTLGYDILTGYPPPYYYYDMDVWGRGTLVTVSSGGGGSGGGGSGGGGSQSVLTQPPSVSAAPGQKVTISCSGSTSNIGNNYVSWYQQHPGKAPKLMIYDVSKRPSGVPDRFSDSKSGNSASLDISGLQSEDEADYYCAAWDDSLSEFLFGTGTKLTVLG

SEQ ID NO: 1611 - protein, 253 aa, Homo sapiens
AVQGAEVKKPGASVKVSCKASGYTFTSYGISWVRQAPGQGLEWMGWISAYNGNTKYAQELQGRVTMTTDTSTSTAYMELRSLRSDDTAVYYCARDTLGYDILTGYPPPYYYYDMDVWGRGTLVTVSSGGGGSGGGGSGGGGSQSVLTQPPSVSAAPGQKVTISCSGSTSNIGNNYVSWYQQHPGKAPKLMIYDVSKRPSGVPDRFSDSKSGNSASLDISGLQSEDEADYYCAAWDDSLSEFLFGTGTKLTVLG

SEQ ID NO: 1612 - protein, 252 aa, Homo sapiens
QVQLVESGGGLVQPGQSLRLSCAASGFTFSSYDMHWVRQATGEGLEWVSAIGTAGDTYYPGSVKGRFTISRENAKNSLYLQMNSLRAGDTAVYYCARGRHYYDILTGYYNEAFDIWGQGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1613 - protein, 250 aa, Homo sapiens
EVQLVETGGGLVKPGGSLRLSCAASGFTFSDYYMSWIRQAPGKGLEWVSSISSSSSYIYYADSVKGRFTISRDNAKNSLYLQMNSLRAEDTAVYYCAGNYYDVLTQSYYGMDVWGRGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1614 - protein, 243 aa, Homo sapiens
GVQLVQSGAEVKEPGASVRVSCKASGGTFSSFAINWVRQAPGQGLEWVGGIIPVFGTVNHAQKFQGRVTITADELTRTVYMELSSLKSDDTAVYYCAGDNSGTYGYWGQGTLVTVSSGGGGSGGGGSGGGGSQSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLG

SEQ ID NO: 1615 - protein, 245 aa, Homo sapiens
QVQLQQSGAEVKKPGSSVKVSCKASGGSFKSHSLTWVRQAPGEGLEWMGGVLPVFGMVDSAQRFQGRVTITADELTSTVYMELSGLKSEDTAVYYCARGGVTAGRSVYFDSWGRGTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1616 - protein, 250 aa, Homo sapiens
GVQLVQSGAEVKKAGSSVKVSCKASGGIFRSYPISWVRQAPGLGLEWIGGIIPIVGKPNYAQKFQDRVAISADELTTTAYMELSSLTSEDTAVYYCARSPNGDYSGYAWGLEYWGQGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1617 - protein, 248 aa, Homo sapiens
EVQLVQSGAEVKEPGSSVKVSCKASGGTFRKYAVSWLRQAPGQGLEWMGGITPFATTKYAQKFQGRATITADELTNTVYMDLGSLRSEDTAMYYCASYFDGSGYYPVSFSYWGQGTLVTVSSGGGGSGGGGSGGGGSQSVLTQPASVSGSPGQSITISCTGTSSDVGGYNYVSWYQQHPGKAPKLMIYEGSKRPSGVSNRFSGSESGNTASLTISGLQAEDEADYYCSSYTTRSTRVFGGGTKLTVLG

SEQ ID NO: 1618 - protein, 249 aa, Homo sapiens
QVQLVQSGGGLAQPGGSLRLSCTASGFTFSNYGMHWVRQAPGKGLEWIGEIYHSGTASYNPSLKSRVTISVDTSKNQFSLKLSSVTAADTAVYYCARVNYDILTGLGYYFDYWGKGTLVTVSSGGGGSGGGGSGGGGSQSVLTQPPSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLG

SEQ ID NO: 1619 - protein, 253 aa, Homo sapiens
QVQLQESGPGLVKPSQTLSLTCTVSGGSISSGGYYWSWIRQHPGKGLEWIGYIYYSGSTYYNPSLKSRVTISIDTSKNQFSLKLSSVTAADTAVYYCVRSYYDILTGRPYTDAFDIWGKGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1620 - protein, 249 aa, Homo sapiens
GVQLVESGAEVKKPGSSVKVSCQASGGTFSTHAINWVRQAPGQGLEWMGEIIPMSATTRYAQKFQGRLTIIADELTSTVHMELSSLRSEDTAVYYCARPLGITAVRGAKTDAFGIWGRGTMVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1621 - protein, 256 aa, Homo sapiens
QVQLQQSGAEVKKPGASVKVSCKASGYTFATYAMQWVRQAPGQRLEWLGWINAGNGNTKYSQKFQGRVTITSDTSASTAYMELSGLRSEDTAVYYCARDRGASNYDILTGYYAPAQGVAFDIWGRSTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1622 - protein, 248 aa, Homo sapiens
QVQLQQSGAEVKKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGKGTMVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1623 - protein, 248 aa, Homo sapiens
QVQLQQSGAEVKKPGASVKVSCKASGYTFTKYTMHWVRQAPGQGPEWMGWINGGNGDTKYSRKFQGRVTITKDTSASAAYMELSSLGSEDTALYYCARATYDPLTGYSFDGFDIWGRGTMVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1624 - protein, 248 aa, Homo sapiens
EVQLVQSGAEVKKPGASVKVSCRASGYTFTKYTMHWVRQAPGQGPEWMGWINGGSGDTKYSRKFQGRVTITKDTSASAAYMELSSLGSEDTALYYCARATYDPLTGYSFDGFDIWGRGTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1625 - protein, 254 aa, Homo sapiens
GVQLVQSGGGLVKPGGSLRLSCAGSGFTFSDYYMSWIRQAPGKGLEWVSYISNNSSYTNYADSVKGRFTTSRDNAKNSLYLQMNNLRAEDTAVYYCARDGGGYDILTGYQYYYGMDVWGRGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1626 - protein, 255 aa, Homo sapiens [sequence omitted]

SEQ ID NO: 1627 - protein, 252 aa, Homo sapiens
QVQLVQSGGGVVQPGRSLRLSCAASGFTFSSYGMHWVRQAPGKGLEWVAVISYDGSNKYYADSVKGRFTISRDNSKNTLYLQMNSLRAEDTAVYYCARSPGDDILTGYYKYYFDYWGQGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1628 - protein, 253 aa, Homo sapiens
EVQLVQSGGGVVQPGRSLRLSCAASGFTFTSYAMHWVRQAPGKGLEWVADISYDGTKEFYADSARGRFTVSRDNSRNTVYLQVNSLGVEDTAVYYCATDAGESYDILTGYYVIEGYMDVWGRGTLVTVSSGGGGSGGGGSGGGGSSELTQDPAVSVALGQTVRITCQGDSLRSYYASWYQQKPGQAPVLVIYGKNKRPSGIPDRFSGSSSGNTASLTITGAQAEDEADYYCNSRDSSGNHVVFGGGTKLTVLG

SEQ ID NO: 1629 - protein, 249 aa, Homo sapiens
QVQLQQSGAEVKKPGSSVKVSCKASGGTFKYYTYSWIRQAPGQWLEWMGGINPIRGTANYAQHFRGRVTIIADELTSTVYMDLSGLGSDDTAVYFCATEGAADYLNGQYFQHWGRGTLVTVSSGGGGSGGGGSGGGGSQSVLTQPASVSGSPGQSITISCTGTSSDIGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1630 - protein, 246 aa, Homo sapiens
QVQLQQSGPEVKKPGASVRVSCKASGYTFNTHGISWVRQAPGQGLEWMGWISVYNGNAISAQKFQGRITMTTDTLTSTAFMELKSLRSDDTGVYYCAREGSWSGLDLDYWGQGTMVTVSSGGGGSGGGGSGGGGSQSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLG

SEQ ID NO: 1631 - protein, 253 aa, Homo sapiens
QVQLQQSGSEVKKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGQGTMVTVSSGGGGSGGGGSGGGGSQSVLTQPPSASGTPGQRVTISCSGSSSNIGSNTVNWYQRLPGAAPQLLIYNDDQRPSGIPDRFSGSKSGTSATLGITGLQTGDEADYYCGTWDSSLSGGLSVFGAGTKVTVLG

SEQ ID NO: 1632 - protein, 250 aa, Homo sapiens
GVQLVQSGAEVKKPGSSVKVSCQTSGTTFRHSAITWVRQAPGQGFEWLGHIIPVFETAHLSDKFQGRVTITADELTTTVYMELSSLRFEDTAVYYCARVSGYNSGYFESYDMDVWGQGTLVTVSSGGGGSGGGGSGGGGSQSVLTQPTSVSGSPGQSITISCTGTSSDVGGYNYVSWYQQHPGKAPKLMIYEGSKRPSGVSNRFSGSKSGNTASLTISGLQAEDEADYYCSSYAGSNGVFGGGTKLTVLG

SEQ ID NO: 1633 - protein, 247 aa, Homo sapiens
QVQLQQSGAEVKKPGSSVKVSCRASERTVRTSDISWIRQAPGQRLEWMGMIIPIFGTTTYAQQFQGRVSIDVDALTSTSVLELGSLTPEDTAIYYCATQGGQYDSPPLDVWGRGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1634 - protein, 252 aa, Homo sapiens
QVQLVQSGGGVVQPGGSLRLSCAASGFTFSSYSMNWVRQAPGKGLEWVSYISRSSRSIYYADSVKGRFTVSRDNAKNSLYLQMSSLRAEDTAVYYCARDRDYDILTDYSNYGMDVWGQGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1635 - protein, 249 aa, Homo sapiens
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARAPLYDILTGYYIGGNDYWGQGTMVTVSRGGGGSGGGGSGGGGSDVVMTQSPSSVSASVGDRVTITCRASQGISSYLAWYQQKPGKAPKLLIYAASTLQSGVPSRFSGSGSGTDFTLTISTLQPEDVATYYCENYNSVPLSFGGGTKLEIKR

SEQ ID NO: 1636 - protein, 253 aa, Homo sapiens
QVQLVQSGAGVKKPGASVKVSCKASGYTFTSYGISWVRQAPGQGLEWMGWISAYNGNTNYAQKLQGRVTMTTDTSTSTAYMELRSLRSEDTAVYYCARDKDYDILTGYWRDELLDYWGQGTTVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1637 - protein, 252 aa, Homo sapiens
QVQLVQSGGGLVQPGGSLRLSCAASGFTFSRHAMSWVRQAPGKGLEWVSGISGSGGSTYYGDLVKGRFTISRDNSKNTLYLQMNSLRAEDTAVYYCAKDPNYDILTGYYYYAMDVWGQGTLVTVSSGGGGSGGGGSGGGGSQSVLTQPASVSGSPGQSITISCTGTSSDVGGYNYVSWYQQHPGKAPKLMIYEGSKRPSGVSNRFSGSESGNTASLTISGLQAEDEADYYCSSYTTRSTRVFGGGTKLTVLG

SEQ ID NO: 1638 - protein, 246 aa, Homo sapiens
QVQLVQSGAEVKKPGASVKVSCKASGYTFTDYYMHWVRQAPEQGLEWMGWINTNSGGTNYAQKFQGRVTMTRDTSISTAYMELSRLRSDDTAVYYCAREFDQLLARGHGMDVWGQGTLVTVSSGGGGSGGGGSGGGGSSELTQDPPVSVALGQTVRITCQGDSLRSYYTNWFQQKPGQAPLLVVYAKNKRPSGIPDRFSGSSSGNTASLTITGAQAEDEADYYCHSRDSSGNHVLFGGGTKLTVLG

SEQ ID NO: 1639 - protein, 244 aa, Homo sapiens
EVQLVQSGAEVKKPGSSVKVSCKASGDTFSSYAISWVRQAPGQGLEWMGGILPIFGTAKYAEKFEDRVTITADELTRTAYMELRRLRSEDTAVYYCARAGSSLMTYGTDVWGRGTLVTVSSGGGGSGGGGSGGGGSSELTQDPAVSVALGQTVRITCQGDSLRSYYTNWFQQKPGQAPLLVVYAKNKRPSGIPDRFSGSSSGNTASLTITGVQAEDEADYYCHSRDSSGNHVLFGGGTKLTVLG

SEQ ID NO: 1640 - protein, 256 aa, Homo sapiens
QVQLVQSGAEVKKPGSSVKVSCKASGYTFTGYYMHWVRQAPGQGLEWMGWINPNSGGTNYAQKFQGWVTMTRDTSISTAYMELSSLRSEDTAVYYCARARGSYDILTGYYRPGDGYFDYWGRGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1641 - protein, 249 aa, Homo sapiens
QVQLQQSGAKVKRPGSSVKVSCRPSGATFSGYALSWVRQAPGQGLEWLGRIIPILGTSNFAQKFQDRLTMSADELTSTVYMELDSLTSEDTAIYYCARGLYFEDTNYRHGDAFDIWGQGTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1642 - protein, 255 aa, Homo sapiens
QVQLQQWGAGLLKPSETLSLTCAVYGGSFSGYYWSWIRQSPGKGLEWIGEINHGGSTNYNPSLKSRVTISVDASKNQFSLKLSSVTAADTAVYYCARERSYYDILTGYSPRSKYGMDVWGRGTLVTVSSGGGGSGGGGSGGGGSQSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLG

SEQ ID NO: 1643 - protein, 248 aa, Homo sapiens
QVQLQQSGAEVKKPGASVKVSCKASGYTFTKYTMHWVRQAPGQGLEWMGWINGGSGDTKYSRKFQGRVTITKDTSASAAYMELSSLGSEDTALYYCARATYDPLTGYSFDGFDIWGQGTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1644 - protein, 250 aa, Homo sapiens
KVQLVQSGAVVKKPGSSVKVSCKASGGTFRNNAFSWVRQAPGQGLEWVGGIIPVFETINTAQKFQGRVTITADELTTTAYMELSSLRVDDTAVYYCATERGVVTAYGGDSFDLWGRGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1645 - protein, 250 aa, Homo sapiens
QVQLQQWGAGLLKPPETLSLTCAVSGGSLNGYYWGWVRQPPGKGLEWIGETNHRGTTNYNPSLKSRVTISVDTSKNHVLLRMTSVTAADTAVYYCARRYSDALTGYSLGAFDVWGRGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1646 - protein, 252 aa, Homo sapiens
EVQLVQSGAEVRKPGSSVKVSCKASGGTFRTFNSSAISWVRQAPGQGLEWMGIIHPSGGSTSQVQKFQGRLTMTRDTPTSTVYMELSSLRSEDTAVYYCARGAYYDILTGYYPYGMDVWGRGTTVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1647 - protein, 250 aa, Homo sapiens
QVQLVQSGAEMKKPGASVKVSCKASGYTFFDSYIHWVRQAPGHGLEWMGWINANNGGTKYAQKFQGRVTMTRDTSISTAYMELSRLRSDDTAVYYCARDYPIDVLTGRRTKNWFDPWGQGTMVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1648 - protein, 248 aa, Homo sapiens
QVQLVESGGGVVQPGRSLRLSCTASGFTFSNYAIHWVRQAPGKGLEWVTVISDDGNNVNYEDSVKGRFTISRDNVKQSVYLQMNSLRAEDTAVYYCARDQVDRLLMQYNYYMDAWGKGTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1649 - protein, 251 aa, Homo sapiens
QVQLQQSGAEVKKPGSSVKVSCKASGGTFSSHYIAWVRQAPGQGLEWMGRVMPALGTANYAQRFQGRVTFTADKSTTTAYMELSSLRSEDTAVYYCARATYDPLTGYSFDGFDIWGRGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTQVFGGGTKLTVLG

SEQ ID NO: 1650 - protein, 253 aa, Homo sapiens
QVQLVESGGGLVKPGGSLRLSCAASGFTLSNAWMSWVRQAPGKGLEWVGRIKSKTDGGTTDYAAPVKGRFTISKDDSKNTLYLQMNSLKTEDTAVYYCTTDAYYDILTGWVYGMDVWGRGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1651 - protein, 247 aa, Homo sapiens
QVQLQESGPGLVKPSETLSLTCTVSNYSISSGYYWGWIRQPPGKGLEWIGSIYYSGSTYYNPSLKSRVTISVDTSKNQFSLKLSSVTAADTAVYYCARFRYDILTGYYYDMDVWGRGTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1652 - protein, 247 aa, Homo sapiens
QMQLVQSGGGLVQPGGSLRLSCAASGFTFSSYAMSWVRHTPGKGLEWVSAISGGGGSTYYADSVKGRFTISRDNAKNSLYLQMNSLRAEDTAVYYCAREYYDILTGYSGAFDIWGRGTLVTVSSGGGGSGGGGSGGGGSSELTQDPAVSVALGQTVRITCQGDSLRSYYTNWFQQKPGQAPLLVVYAKNKRPSGIPDRFSGSSSGNTASLTITGAQAEDEADYYCHSRDSSGNHVLFGGGTKLTVLG

SEQ ID NO: 1653 - protein, 248 aa, Homo sapiens
EVQLVQSGGGLVQPGGSLRLSCAASGFTFSIYAMSWVRQAPGKGLEWVSAISHNADHTYSADSVKGRFTISRDNSKNTLYLQMNSLRAEDTAIYYCAATRMDVLTRYYSDFWGQGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1654 - protein, 247 aa, Homo sapiens
QVQLLQSAAEVKKPGSSVKVSCKASGDTFSSYAISWVRQAPGQGLEWMGGILPIFGTAKYAEKFEDRVTITADELTRTAYMELRRLRSEDTAVYYCARAGSSLMTYGTDVWGRGTTVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1655 - protein, 246 aa, Homo sapiens
GVQLVQSGAEVKKPGSSVKVSCKASGGTFKYYTFSWIRQAPGHWLEWMGGINPIRGTANYAQKSRGGVTITADELTNTVYMELTSLESDDTAVYFCAAEGAADYLNGQYFQHWGKGTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1656 - protein, 252 aa, Homo sapiens
KVQLVQSGAEVKKPGSSVKVSCKASGGTLSRYAISWVRQAPGQGLEWMGGIIPVFGTENYSQKFQGRVSITADELTNTAYMELRRLRSEDTAQYYCAADTRVIGIQLWERGAFDMWGKGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1657 - protein, 248 aa, Homo sapiens
PVQLQQSGAEVKKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGRGTMVTVSSGGGGSGGGGSGGGGSSELTQDPAVSVVLGQTVRITCQGDSLRSYYVSWYQQKPGQAPVLVIYGKNNRPSGIPDRFSGSSSGNTASLTITGAQAEDEADYYCNSRDSSGNHVVFGGGTKLTVLG

SEQ ID NO: 1658 - protein, 252 aa, Homo sapiens
EVQLVQSGAEVKKPGSSVKVSCQASGGTFSTHAINWVRQAPGQGLEWMGGIIPMSATTRYAQKFQGRLTIIADELTSTVHMELSSLRSEDTAVYYCARPLGITAVRGAKTDAFGIWGRGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1659 - protein, 254 aa, Homo sapiens
QVQLQQSGPGLLKPSETLSLTCAVYGGSFSGYYWSWIRQPPGKGLEWIGEINHSGSTNYNPSLKSRVTISVDTSKNQFSLKLSSVTAADTAVYYCARGRRYYDILTGYSLGRGEMDVWGRGTLVTVSSGGGGSGGGGSGGGGSQSVLTQPPSVSAAPGQKVTISCSGSTSNIGNNYVSWYHQHPGKAPKLMIYDVSKRPSGVPDRFSGSKSGNSASLDISGLQSEDEADYYCAAWDDSLSEFLFGAGTKLTVLG

SEQ ID NO: 1660 - protein, 248 aa, Homo sapiens
QVQLQQSGAEVKKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGQGTLVTVSSGGGGSGGGGSGGGGSSELTQDPAVSVALGQAVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1661 - protein, 247 aa, Homo sapiens
EVQLVQSGAEVKKPGSSVKVSCKTSGGTFSSYAISWVRQAPGQGLEWMGGILPIFGPARYAEKFQGRVTITADELTRTAYMELKTLRSDDTAVYYCARAGTSLMNYGTDVWGRGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1662 - protein, 248 aa, Homo sapiens
QVQLQQSGAEAKKPGASVKVSCKASGHTFTSYVISWVRQAPGQGLEWMGWITAYNGNTNYAQKLQGRVTLTTDTSTNTAYMELRSLRSDDTAVYYCARGPYDVLTGYLSGNFDYWGKGTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1663 - protein, 247 aa, Homo sapiens
QVQLQQSGAEVKKPGSSVKVSCRASERTVRTSDISWIRQAPGQRLEWMGMIIPIFGTTTYAQQFQGRVSIDVDALTSTSVLELGSLTPEDTAIYYCATQGGQYDSPPFDVWGRGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1664 - protein, 259 aa, Homo sapiens
QVQLVQSGGALVQPGRSLRLSCAASGFTFNDYGMHWVRQAPGKGLEWVSGVSWNSGSIAYAESVKGRFTISRDNAKNSLSLQMNSLRAEDTAVYYCARGEKARYYDILTGYYSAWGGYYMDVWGRGTLVTVSSGGGGSGGGGSGGGGSQSVLTQPASVSGSPGQSITISCTGTSSDVGGYNYVSWYQQHPGKAPKLMIYEGGKRPSGVSNRFSGSKSGNTASLTISGLQAEDEADYYCSSYTTRSTRVFGGGTKLTVLG

SEQ ID NO: 1665 - protein, 248 aa, Homo sapiens
EVQLVQSGAEVKKPGSSVKVTCKASGGTFSNYVISWVRQAPGQGLEWMGRITPILGTPNLAQKFQGRLTITADELTKTAYMELSRLTSEDTAVYYCATLNLEKTVIRGFGYFDLWGKGTMVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1666 - protein, 252 aa, Homo sapiens [sequence omitted]

SEQ ID NO: 1667 - protein, 248 aa, Homo sapiens
GVQLVQSGAEVKKLGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGKGTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1668 - protein, 248 aa, Homo sapiens
GVQLVQSGSEVKKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGRGTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1669 - protein, 251 aa, Homo sapiens
EVQLVESGAEVKRPGSSVKVSCKAHGGTFSSSMISWVRQAPGQGLEWMGGFIPIFGTERKAPKFQGRVTLTADESTSTAYMELRSLRSEDTAVYYCATSPYDTLTGYVYNGVDVWGKGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLRAEDEADYYCSSYTTRSTRVFGGGTKLTVLG

SEQ ID NO: 1670 - protein, 248 aa, Homo sapiens
QVQLQQSGAEVKKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGQGTMVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLAVLG

SEQ ID NO: 1671 - protein, 251 aa, Homo sapiens
QVTLKESGAEVKKPGSSVKVSCKASGGTFSNYAISWVRQAPGQGLEWMGGIIPIFGTTNYAEKFQGRLTITADELTNTTYMELSSLRSEDTAVYYCARVAAAGARTLGYFGMDVWGGGTLVTVSSGGGGSGGGGSGGGGSQSVLTQPPSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLG

SEQ ID NO: 1672 - protein, 253 aa, Homo sapiens
QVQLVQSGAEVKKPGDSVRVSCKASGYTFTSHYMHWVRQAPGQGLEWMGVINPTGSATNYAQKFQDRVTMTRDTSTSTDYMELSSLRSEDTAVYYCARDVSGHDILTGYSYRYFDVWGRGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1673 - protein, 254 aa, Homo sapiens
QVQLVESGGGMVQPGGSLRLSCAASGFTFSTYGMAWVRQAPGKGLEWVSVIENSGGTTYYADSVKGRFTISRDNSKNTLYLQLNSLSAEDTAVYYCANSPMYYDRLTGFYPSGYFDSWGRGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1674 - protein, 252 aa, Homo sapiens
QVQLQQSGAEVRKPGASVKVSCKASGYTFTSYGISWVRQAPGQGLEWMGWISGYNDNTNYAQKLQGRVTLTTDTSTSTAYMELRSLRSDDTAVYYCARGAYYDILTGYYPYGMDVWGQGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1675 - protein, 248 aa, Homo sapiens
QVQLQQSGAEVRRPGASVRVSCQASGYTFTNFAIHWVRQAPGQRLEWLGRIIPILGTSNFAQKFQDRLTMSADELTSTVYMELDSLTSEDTAIYYCARGPSSAGTTIGLGSFDPWGQGTLVTVSSGGGGSGGGGSGGGGSSELTQDPAVSVALGQTVRITCQGDSLRSYYAGWYQQKPGQAPVLVIYGKNNRPSGIPDRFSGSSSGNTASLTITGAQAEDEADYYCNSRDSSGNHVVFGGGTKLTVLG

SEQ ID NO: 1676 - protein, 250 aa, Homo sapiens
AVQLVQSGAEVKQPGSSVNVSCKVSGGTFGSSGITWVRQAPGEGLEWMGRIIPVLGTTNYAQRFQGRVTIIADELTNTVNMELSGLRSEDTATYYCARETRKYTSSPPYNYYYMDVWGKGTLVTVSSGGGGSGGGGSGGGGSSELAQDPAVSVASGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1677 - protein, 243 aa, Homo sapiens
EVQLQQSGAEVRKPGSSVRVSCRFTESPIHWVRQAPGRGLEWLGGFDREEGKTLYAQKFQGRVILTEDFLTKTAYLEMRTLRSDDTAVYYCVFDQFSVGGRHAFDLWGRGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDGADYYCSSYTTRSTRVFGGGTKLTVLG

SEQ ID NO: 1678 - protein, 242 aa, Homo sapiens
QVQLQQSGAEVKKPGSSVKVSCKASGGTFSNYAFSWVRQAPGQGLEWMGGIIPIFGTANYAQKLQGRVTITADELTRTVYMDLSSLRSEDTAVYYCATGMGDHYGMDVWGKGTMVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1679 - protein, 248 aa, Homo sapiens
QVQLQQSGAEVKKPGASVKVSCKASGYTFTKYTMHWVRQAPGQEPEWMGWINGGSGDTKYSRKFQGRVTITKDTSASAAYMELSSLGSEDTALYYCARATYDPLTGYSFDGFDIWGRGTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1680 - protein, 247 aa, Homo sapiens
QVQLVQSGAEVKKPGSSVKVSCKASGDTFSSYAISWVRQAPGQGLEWMGGILPIFGTAKYAEKFEDRVTITADELTRTAYMELRRLRSEDTAVYYCARAGSSLMTYGTDVWGRGTMVTVSSGGGGSGGGGSGGGGSQSVLTQTACVSGSPGQSITVSCTGTSSDVGGYNYVSWSHQHPGKAPKLMIYEGSKRPSGVSNRFSGSKSGITASLTISGLQAEDEADYYCSSYTTRSTRVFAGGTKLTVLG

SEQ ID NO: 1681 - protein, 248 aa, Homo sapiens
QVQLQQSGAEVKKPGASVKVSCKASGYTFTKYTMHWVRQAPGQGLEWMGWINGGSGDTKYSRKFQGRVTITKDTSASAAYMELSSLGSEDTALYYCARATYDPLTGYSFDGFDIWGRGTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1682 - protein, 247 aa, Homo sapiens
QVQLQQSGAEVKKPGSSVKVSCKASGDTFSSYAISWVRQAPGQGLEWMGGILPIFGTAKYAEKFEDRVTITADELTRTAYMELRRLRSEDTAVYYCARAGSSLMTYGTDVWGRGTMVTVSSGGGGSGGGGSGGGGSQSVLTQPPSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLG

SEQ ID NO: 1683 - protein, 250 aa, Homo sapiens
GVQLVQSGAVVKKPGSSVKVSCKASGGTFRNNAFSWVRQAPGQGLEWVGGIIPVFETINTAQKFQGRVTITADELTTTAYMELSSLRVDDTAVYYCATERGVVTAYGGDSFDLWGQGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1684 - protein, 253 aa, Homo sapiens
QVQLVQSGAEVKKPGSSVKVSCQASGGTFSTHAINWVRQAPGQGLEWMGGIIPMSATTRYAQKFQGRLTIIADELTSTVHMELSSLRSEDTAVYYCARPLGITAVRGAKTDAFGIWGRGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCASWDDSLNGRVFGGGTKLTVLG

SEQ ID NO: 1685 - protein, 247 aa, Homo sapiens
QVQLVQSGAEVKKPGSSVKVSCKASGDTFSSYAISWVRQAPGQGLEWMGGILPIFGTAKYAEKFEDRVTITADELTRTAYMELRRLRSEDTAVYYCARAGSSLMTYGTDVWGQGTPVTVSSGGGGSGGGGSGGGGSQSVLTQPPSASGSPGQSVTISCTGTSSDVGGYNYVSWYQQHPGKAPKFMIYDVSKRPSGVSNRFSGSKSGNTASLTISGVQAEDEADYYCSSYTSASTVIFGGGTKLTVLG

SEQ ID NO: 1686 - protein, 244 aa, Homo sapiens
GVQLVQSGAEVKKPGSSVRVSCKASGGTSSRFGVSWVRQAPGQGLEWMGGINRIRPTLNIAQKFQGRLVINVDELTNTTYMELTSLTSEDTAIYYCTRDWGHWFDPWGRGTLVTVSSGGGGSGGGGSGGGGSAQSALTQPASVSGSPGQSITISCTGTSSDVGGYNYVSWYQQHPGKAPKLMIYEVSNRPSGVSNRFSGSKSGNTASLTISGLQAGDEADYYCSSYTTRSTRVFGGGTKLTVLG

SEQ ID NO: 1687 - protein, 247 aa, Homo sapiens
QVQLVQSGAEVKKPGSSVKVSCKASGDTFSSYAISWVRQAPGQGLEWMGGILPIFGSAKYAEKFEDRVTITADELTRTAYMELRRLRSEDTAVYYCARSGSSLMTYGTDVWGRGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1688 - protein, 251 aa, Homo sapiens
QVQLVQSGAKVKKPGASVKVSCKASGYTFTGYYMHWVRQAPGQGLEWMGWINPNSGGTNYAQKFQGRATITADKATSTAYMEVSSLRSEDTAVYYCATEPYDILTGYYGSYFDYWGRGTMVTVSSGGGGSGGGGSGGGGSQSVLTQPASVSGSPGQSITISCTGTSSDVDGYNYVSWYQQHPGKAPKLMIYEGSKRPSGVSNRFSGSKSGDTASLTISGLQAEDEADYYCSSYTTRSTRVFGGGTKLTVLG

SEQ ID NO: 1689 - protein, 247 aa, Homo sapiens
QVQLLQSAAEVKKPGSSVKVSCKASGDTFSSYAISWVRQAPGQGLEWMGGILPIFGTAKYAEKFEDRVTITADELTRTAYMELRRLRSEDTAVYYCARAGSSLMTYGTDVWGKGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1690 - protein, 252 aa, Homo sapiens
QVQLQQWGGGVVQPGRSQRLSCVASGFTFSTYGMHWVRQAPGKGLEWVAVISYDGSKKYYGDSVKGRFTISRDNSKNTVYLQMNSLRAEDTAMYYCANTYYDILTGYSGGGAFDYWGQGTMVTVSSGGGGSGGGGSGGGGSQSVLTQPASVSGSPGQSITISCTGTSGDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1691 - protein, 246 aa, Homo sapiens
QVQLVQSGAEVKKPGSSVKVSCKASGGALSNYGVAWVRQAPGQGLEWMGWISGYDGTTKYAQNFQDRVTMTTDTLTKTAYMELRSLRSDDTAVYYCTRGSRVRGVTPDLWGRGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1692 - protein, 244 aa, Homo sapiens
QVQLLQSAAEVKKPGSSVKVSCKASGDTFSSYAISWVRQAPGQGLEWMGGILPIFGTAKYAEKFEDRVTITADELTRTAYMELRRLRSEDTAVYYCARAGSSLMTYGTDVWGRGTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1693 - protein, 256 aa, Homo sapiens
QVQLQQSGAEMKKSGSSVKVSCKASGGTFSHSVFSWVRQAPGQGLEWMGGITPMFDTVNYAQKFQGRVTIIADKLTNTVHMEVSSLRSEDTAVYFCASECSGSSCPARQPPYYQYYMDVWGRGTTVTVSSGGGGSGGGGSGGGGSQSVLTQPPSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLG

SEQ ID NO: 1694 - protein, 244 aa, Homo sapiens
QVQLVQSGAEVKKPGSSVKVSCKASGDTFSSYAISWVRQAPGQGLEWMGGILPIFGTAKYAEKFEDRVTITADELTRTAYMELRRLRSEDTAVYYCARAGSSLMTYGTDVWGRGTMVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1695 - protein, 252 aa, Homo sapiens
EVQLVQSGAEMKKPGSSVKVSCKASGGTFGNYAINWVRQAPGQGFEWMGIIHPSGGSTSQVQKFQGRLTMTRDTSTSTVYMELSSLRSEDTAVYYCARGAYYDILTGYYPYGMDVWGKGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1696 - protein, 247 aa, Homo sapiens
QVQLQQSGAEVKKPGSSVKVSCRASERTVRTSGISWIRQAPGQRLEWMGMIIPIFGTTTYAQQFQGRVSIDVDALTSTSVLELGSLTPEDTAIYYCATQGGQYDSPPLDVWGRGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1697 - protein, 247 aa, Homo sapiens
QVQLLQSAAEVKKPGSSVKVSCKASGDTFSSYAISWVRQAPGQGLEWMGGILPIFGTARYAEKFEDRVTITADELTRTAYMELRRLRSEDTAVYYCARAGSSLMTYGTDVWGRGTLVTVSSGGGGSGGGGSGGGGSQSALTQPASVSGSRGQSITISCTGTTGDVGGYDYVSWYQQHPGKAPKLLIYGNSNRPSGVPDRFSASKSGNTASLTISGLQAEDEADYFCSTYAPPGIIMFGGGTKLTVLG

SEQ ID NO: 1698 - protein, 252 aa, Homo sapiens
QVTLKESGAQVKKPGASVKVSCKASGYTFTSYAIHWVRQAPGQRLEWMGRINAGNGNTKYSQKFQGRVTITRDTSASTAYMELNSLRSEDTAVYYCARGAYYDILTGYYPYGMDVWGRGTLVTVSSGGGGSGGGGSGGGGSQSVLTQPPSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLG

SEQ ID NO: 1699 - protein, 254 aa, Homo sapiens
QVQLQQSGAEVKKPGSSVKVSCKASGGTFSSYAISWVRQAPGQGLEWMGRIIPILGIANYAQKFQGRVTITADKSTSTAYMELSSLRSEDTAVYYCARDYRNYDILTGHPYYYGMDVWGRGTTVTVSSGGGGSGGGGSGGGGSQSVLTQPASVSGSPGQSITISCTGTSSDVGGYNYVSWYQQHPGKAPKLMIYEGSKRPSGVPNRFSGSKSGNTASLTISGLQAEDEADYYCSSYTTRSTRVFGGGTKLTVLG

SEQ ID NO: 1700 - protein, 248 aa, Homo sapiens
QVQLVQSGAEVKKPGASVKVSCKASGYSFTSYAMHWVRQAPGQGLEWMGKINPSGTSVTYAQRFQGRVTLTRDTSTSTNYMEVNSLRSEDTAVYYCAGQHYDILTGYSQEPFDIWGRGTLVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKR

SEQ ID NO: 1701 - protein, 254 aa, Homo sapiens
QVQLQESGGGLVKPGGSLRLSCAASGFTFSSYAMSWVRQAPGKGLEWVSAISGSGGSTYYADSVKGRFTISRDNSKNTLYLQMNSLRAEDTAVYYCAKDQTYYDILTGHYYYYGMDVWGRGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1702 - protein, 246 aa, Homo sapiens
QVQLQQWGAEVKKPGSSVKVSCKASGGTFKYYTYSWIRQAPGQWLEWMGSINPVRGTANYAQHLRGRVTIIADELTSTVYMDLSGLGSDDTAVYFCATEGAADYLNGQYFQHWGQGTLVTVSSGGGGSGGGGSGGGGSSELTQDPAMSVALGQTVRITCQGDSLRSYYASWYQQKPGQAPVLVIYGRNNRPSGIPDRFSGSSSGNTASLTITGAQAEDEADYYCNSRDSSGNHVVFGGGTKLTVLG

SEQ ID NO: 1703 - protein, 247 aa, Homo sapiens
QVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCATLGYYDILTGYRSDDYWGKGTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1704 - protein, 247 aa, Homo sapiens
QVQLVQSGAEVKKPGSSVKVSCKASGDTFSSYAISWVRQAPGQGLEWMGGILPIFGTAKYAEKFEDRVTITADELTRTAYMELRRLRSEDTAVYYCARAGSSLMAYGTDVWGRGTTVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSHTTRSTRVFGGGTKLTVLG

SEQ ID NO: 1705 - protein, 248 aa, Homo sapiens
QVQLQQSGAEVKKPGSSVKVSCKASGGTFSSYAISWVRQAPGQGLEWMGRIIPIVNMANYAQKFQGRVTLTADKSTGTAYMELTSLRSEDTAVYYCARENYDFLTGYYGAFDIWGRGTMVTVSSGGGGSGGGGSGGGGSSELTQDPAVSVALGQTVRITCQGDSLRSYYASWYQQKPGQAPVLVIYGKNNRPSGIPDRFSGSSSGDTASLTITGAQAEDEADYYCNSRDSSSTHRGVFGGGTKLTVLG

SEQ ID NO: 1706 - protein, 251 aa, Homo sapiens
QVQLQQSGAEVKKPGASVKISCKASGYTFTNNVMHWVRQAPGQGPEWMGWINGGSGDTKYSRKFQGRVTITKDTSASAAYMELSSLGSEDTALYYCARATYDPLTGYSFDGFDIWGQGTLVTVSSGGGGSGGGGSGGGGSQSVLTQPASVSGSPGQSITISCTGTSSDVGGYNYVSWYQQHPGKAPKLMIYEGSERPSGVSNRFSGSKSGNTASLTISGLQAEDEADYYCSSYTTRSTRVFGGGTKLTVLG

SEQ ID NO: 1707 - protein, 247 aa, Homo sapiens
QVQLQQSGAEVKKPGSSVKVSCKASGDTFSSYAISWVRQAPGQGLEWMGGILPIFGTAKYAEKFEDRVTITADELTRTAYMELRRLRSEDTAVYYCARAGSSLMTYGTDVWGKGTLVTVSPGGGGSGGGGSGGGGSQSVLTQPPSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLG

SEQ ID NO: 1708 - protein, 251 aa, Homo sapiens
QVQLVQSGGGVVQPGRSQRLSCAASGFTFSSYGMSWVRQAPGKGLEWVSAISGSGGSTYYADSVKGRFTISRDNSKNTLYLQMNSLRAEDTAVYYCARGGLYDILTGRPATDDAFDIWGRGTMVTVSSGGGGSGGGGSGGGGSSELTQDPAVSVALGQTVRITCQGDSLRSYYTNWFQQKPGQAPLLVVYAKNKRPSGIPDRFSGSSSGNTASLTITGAQAEDEADYYCHSRDSSGNHVLFGGGTKLTVLG

SEQ ID NO: 1709 - protein, 254 aa, Homo sapiens
EVQLVQSGAEVKKPGSSVKVSCKASGGRFNRYATTWVRQAPGQGLEWMGGIIPLFGTTKYAQRLQGRVTITADELTNTVFMELRSLRSEDTALYYCATTDRFGAKDVTARWGMDVWGRGTMVTVSSGGGGSGGGGSGGGGSAQAVLTQPSSVSGAPGQRVTISCTGSSSNIGAPYDVHWYQQFPGTAPKLLMYGNSNRPSGVPDRFSGSKSGTSASLAITGLQAEDEADYYCQSYDSSLSGSVFGTGTKVTVLG

SEQ ID NO: 1710 - protein, 257 aa, Homo sapiens
QVQLQQSGAEVKKPGSSVKVSCKASGGALSSDAISWVRQAPGQGLEWMGGIIPTFRKTKYAQKFQGRVTITADELTRTVFMELSSLKSEDTAVYYCARGREDTDKVKPWDRYYHYYYMDVWGRGTMVTVSSGGGGSGGGGSGGGGSAQSALTQPASVSGSPGQSLTISCTGTSRDVGGYNYVSWYQQHPGKAPKLIIYDVSKRPSGVSNRFSGSKSGNTASLTISGLQAEDEADYYCSSYRSSSTMFGGGTKVTVLG

SEQ ID NO: 1711 - protein, 247 aa, Homo sapiens
EVQLVQSGAEVKKPGSSVKVSCKASGGTVSSRTISWVRQAPGQGLEWMGGSLPPSGAPIYAQKFQGRVAITADALTNTAFMELRSLKSDDTAVYYCARDQGRYLDLWGQGTLVTVSSGGGGSGGGGSGGGGSALSYVLTQPPSASGAPGQRVTISCSGSSSNIGSNFVNWYQQVPGTAPKLLIYRDIQRPSDTGVPDRFSGAKSATSASLAISGLRSEDGADYYCAAWDDSLSGPVFGGGTKLTVLG

SEQ ID NO: 1712 - protein, 251 aa, Homo sapiens
QVQLVQSGAEVKKPGSSVKVSCRASGGSFNHAISWVRQAPGRGLEWMGGILPMYGTANYAQKFQGRVTITADKLTNTVYMDLSRLRYEDTAVYYCARELGLSIVGATTGALDMWGKGTLVTVSSGGGGSGGGGSGGGGSAQSVLTQPPSVSGAPGQRVTISCTGTSSNIGAGYDVHWYQQLPGTVPKLVIYGNNNRPSGVSDRFSGSKSGTSASLAITRLQAEDEAYYYCQSYDTGLSGLFGGGTQLTVLS

SEQ ID NO: 1713 - protein, 252 aa, Homo sapiens
EVQLVQSGAEVRKPGSSVRVSCEASGGKFSNYSLNWLRQAPGQGPEWMGRIIPVLDIVDYAPKFQGRLTITADKLTGTIFMELNSLRAEDTAIYYCARELGHREGGYWYSPYNVWGRGTMVTVSSGGGGSGGGGSGGGGSAQSVLTQPPSVSGTPGQGVSISCSGSSSNVGSNTVNWYQQLPGTAPKLLIHTNDQMPSWVPDRFSGSKSGTSASLAIRGLRSEDEAEYFCATWDDSLNAVVFGGGTKLTVLG

SEQ ID NO: 1714 - protein, 245 aa, Homo sapiens
QVQLVQSGPEVKKPGSSVKVSCKASRGPFENYGVSWVRQAPGQGLEWMGRIVPISGATNYAQKFQDRLTLTADELTTTVFMELTSLRSDDTAVYYCAKNMGASAAADFWGRGTMVTVSSGGGGSGGGGSGGGGSALSYELTQPPSVSVSPGQTARITCSGDVLANQYAYWYQQKPGQAPVVVMYQDNERPSGTPERLSGSRSGSTVTLTISGVQAEDEADYYCQSADSTGTYALFGGGTKLTVLG

SEQ ID NO: 1715 - protein, 250 aa, Homo sapiens
QVQLVQSGAEVKKPGSSVKVSCKASGGTFSSYAFNWVRRAPGQGLEWLGSIVPVFNTKTFARKFQGRVTLTADELTRTAYLELSNLRSDDTAVYYCASRYGDPFYYYYYMNVWGKGTLVTVSSGGGGSGGGGSGGGGSAQSVLTQPPSVSAAPGQKVTISCSGSSSNIGDAYVAWFQQLPGTAPKLLIYENNKRPSGIPDRFSGSKSGTSATLGITGLQTGDEADYYCGTWDSSLSAVIFGGGTKVNVLG

SEQ ID NO: 1716 - protein, 258 aa, Homo sapiens
QVQLVQSGSEMKKPGSSVKVSCKASGGTFSTNGISWVRQAPGHGLEWMGRVIPIFGKSKTAQRFQGRLTITADKATDTVYMELSTLRSEDTALYYCARESGSHYDLLTGLLVAANGFDVWGQGTLVTVSSGGGGSGGGGSGGGGSAQAVLTQPSSVSGAPGQRVTISCTGSSSNTGAGYDVHWYQHLPGTAPKLVIYDSGNRPSGVPDRFSGSKSGTSASLAITGLQAEDEANYYCQSYDTSLSGWVFGGGTKLTVLG

SEQ ID NO: 1717 - protein, 248 aa, Homo sapiens
GVQLQQSGAEVKKPGSSVKVSCKASGGTFSSYAISWVRQAPGQGLEWMGGIIPIFGTANYAQKFQGRVTITADESTSTAYMELSSLRSEDTAVYYCARMEYDILTGYYGGYFDYWGQGTLVTVSSGGGGSGGGGSGGGGSDIVMTQSPSTLSASVGDRVTITCRASQGISSWLAWYQQKPGRAPKVLIYKASTLESGVPSRFSGSGSGTDFTLTISSLQPEDFATYYCQQSYSTPWTFGQGTKLEIKR

SEQ ID NO: 1718 - protein, 248 aa, Homo sapiens
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARMEYDILTGYYGGYFDYWGRGTMVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCHSRDSSGNHVLFGGGTKLTVLG

SEQ ID NO: 1719 - protein, 248 aa, Homo sapiens
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARMEYDILTGYYGGYFDYWGRGTLVTVSSGGGGSGGGGSGGGGSDIVMTQSPSTLSASVGDRVTITCRASQGISSWLAWYQQKPGRAPKVLIYKASTLESGVPSRFSGSGSGTDFTLTISSLQPEDFATYYCQQSYSTPWTFGQGTKLEIKR

SEQ ID NO: 1720 - protein, 249 aa, Homo sapiens
QVQLVQSGAEVKKPGSSVKVSCKASGGTFSSFAISWVRQAPGQGLEWMGWINPNSGGTNYAQKLQGRVTMTTDTSTSTAYMELRSLRSDDTAVYYCARPYYDILTGYFAFDIWGQGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1721 - protein, 248 aa, Homo sapiens
EVQLVESGPEVKKPGTSVKVSCKASGYTFTSYGISWVRQAPGQGLEWMGWINPNSGGTNYAQKFQGRVTMTRDTSISTAYMELGRLRSEDTAVYYCARMEYDILTGYYGGYFDYWGQGTMVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1722 - protein, 250 aa, Homo sapiens
QVQLQQSGAEVKKPGASVKVSCKASGYTFTGYYMHWVRQAPGQGLEWMGWINPNSGGTNYAQKFQGRVTMTRDTSISTAYMELSRLRSDDTAVYYCARVLPHYDILTGYSQNWFDPWGRGTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1723 - protein, 250 aa, Homo sapiens
EVQLQQSGAEVKEPGASVKVSCKASGYTFTGYYMHWVRQAPGQGLEWMGWINPNSGGTNYAQKFQGRVTMTRDTSISTAYMELSRLRSDDTAVYYCARVLPHYDILTGYSQNWFDPWGKGTMVTVSSGGGGSGGGGSGGGGSSELTQDPAVSVALGQTVRITCQGDSLRSYYASWYQQKPGQAPVLVIYGKNNRSSGIPDRFSGSSSGNTASLTITGAQAEDEADYYCNSRDSSGNHVVFGGGTKLTVLG

SEQ ID NO: 1724 - protein, 249 aa, Homo sapiens
QVNLRESGGGVVQPGRSLRLSCAASGFTFSSYGMHWVRQAPGKGLEWVAVISYDGSNKYYADSVKGRFTISRDNSKNTLYLQMNSLRAEDTAVYYCAKDGYYDILTGYSYYGMDVWGRGTMVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1725 - protein, 249 aa, Homo sapiens
QVNLRESGGGVVQPGRSLRLSCAASGFTFSSYGMHWVRQAPGKGLEWVAVISYDGSNKYYADSVKGRFTISRDNSKNTLYLQMNSLRAEDTAVYYCAKDGYYDILTGYSYYGMDVWGKGTMVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1726 - protein, 247 aa, Homo sapiens
QVQLVQSGAEVKKPGASVKVSCKASGYTFTTYGISWVRQAPGQGLEWMGWISAYTGKTNYAQKLQGRVTMTTDTSTSTAYMELRSLRSDDTAVYYCARVYYDILTGYNLFFDYWGRGTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1727 - protein, 248 aa, Homo sapiens
QVQLVQAGADVKKPGSSVKVSCKASGGTFSSYAISWVRQAPGQGLEWMGGIIPIFGTANYAQKFQGRVTITADESTSTAYMELSSLRSEDTAVYYCARMEYDILTGYYGGYFDYWGRGTMVTVSSGGGGSGGGGSGGGGSSELTQDPAVSVALGQTVRITCQGDSLRSYYASWYQQKPGQAPVLVIYGRNNRPSGIPDRFSGSSSGNTVSLTITGAQAEDEADYYCNSRDSSGNHVVFGGGTKLTVLG

SEQ ID NO: 1728 - protein, 248 aa, Homo sapiens
QVQLVQSGAEVKRPGSSVKVSCKASGGTFSSYAISWVRQAPGQGLEWMGGIIPIFGTANYAQKFQGRVTITADESTSTAYMELSSLRSEDTAVYYCARMEYDILTGYYGGYFDYWGRGTLVTVSSGGGGSGGGGSGGGGSSELTQDPAVSVALGQTVRITCQGDSLRSYYASWYQQKPGQAPLLVVYAKNKRPSGIPDRFSGSSSGNTASLTITGAQAEDEADYYCHSRDSSGNHVLFGGGTKLTVLG

SEQ ID NO: 1729 - protein, 247 aa, Homo sapiens
QVQLVQSGAEVKKPGASVKVSCKASGYTFTSYYMHWVRQAPGQGLEWMGWINPNSGGTNYAQKFQGRVTMTRDTSISTAYMELSRLRSDDTAVYYCARGYYDILTGYYDAFDIWGKGTMVTVSSGGGGSGGGGSGGGGSSELTQDPAVSVALGQTVRITCQGDSLRSYYTNWFQQKPGQAPLLVVYAKNKRPSGIPDRFSGSSSGNTASLTITGAQAEDEADYYCHSRDSSGNHVLFGGGTKLTVLG

SEQ ID NO: 1730 - protein, 249 aa, Homo sapiens
EVQLVESGAEVNKPGASVKVSCKASGYTFTDYYIHWVRQAPGQRLEWMGWINAGNGNTNYSQNFQDRVSITRDTSANTVYMELNSLRPEDTAVYYCARDGYYDILTGYSGYYMDVWGRGTMVTVSSGGGGSGGGGSGGGGSSELTQDPAVSVALGQTVRITCQGDSLRSYYASWYQQKPGQAPVLVIYGKDNRPSGIPDRFSGSSSGNTASLTITGAQAEDEADYYCNSRDSSGNHVVFGGGTKLTVLG

SEQ ID NO: 1731 - protein, 252 aa, Homo sapiens
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARDRLEYYDILTGYYYYYGMDVWGRGTLVTVSSGGGGSGGGGSGGGGSSELTQDPAVSVALGQTVRITCQGDSLRSYYTNWFQQKPGQAPLLVVYAKNKRPSGIPDRFSGSSSGNTASLTITGAQAEDEADYYCNSRDSSGNHVVFGGGTKLTVLG

SEQ ID NO: 1732 - protein, 248 aa, Homo sapiens
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARMEYDILTGYYGGYFDYWGRGTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCHSRDSSGNHVLFGGGTKLTVLG

SEQ ID NO: 1733 - protein, 248 aa, Homo sapiens
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARMEYDILTGYYGGYFDYWGQGTLVTVSSGGGGSGGGGSGGGGSDIVMTQSPSTLSASVGDRVTITCRASQGISSWLAWYQQKPGRAPKVLIYKASTLESGVPSRFSGSGSGTDFTLTISSLQPEDFATYYCQQSYSTPWTFGQGTKLEIKR

SEQ ID NO: 1734 - protein, 248 aa, Homo sapiens
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARMEYDILTGYYGGYFDYWGQGTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1735 - protein, 254 aa, Homo sapiens
QVQLVESGGGVVQPGGSLRLSCAASGFTFSGYGMHWVRQAPGKGLEWVASVRNDGSNTYYTDSVKGRFTISRDNTKNTLYLQMNSLRAEDTAVYYCAKSQSDYDILTGYYYYYGMDVWGRGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1736 - protein, 251 aa, Homo sapiens
QVQLQQSGAEVKKPGASVKVSCKASDYTFTSYGISWVRQAPGQGLEWMGWISAYNGNTNYAQKLQGRVTMTTDTSTSTAYMELRSLRSDDTAVYYCARMEYDILTGYYGGYFDYWGQGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1737 - protein, 248 aa, Homo sapiens
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARMEYDILTGYYGGYFDYWGKGTLVTVSSGGGGSGGGGSGGGGSDIVMTQSPSTLSASVGDRVTITCRASQGISSWLAWYQQKPGRAPKVLIYKASTLESGVPSRFSGSGSGTDFTLTISSLQPEDFATYYCQQSYSTPWTFGQGTKLEIKR

SEQ ID NO: 1738 - protein, 251 aa, Homo sapiens
QVQLVQSGAEVKKPGASVKVSCKASGYTFTSYGISWVRQAPGQGLEWMGWISAYNGNTHYAQKLQGRVTMTTDTSTSTAYMELRSLRSDDTAVYYCARMEYDILTSYYGGYFDYWGQGTMVTVSPGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1739 - protein, 254 aa, Homo sapiens
GVQLVESGGGLIQPGGSLRLSCAASGFTVSSNYMSWVRQAPGKGLEWVSAISGSGGSTYYADSVKGRFTISRDNSKNTLYLQMNSLRAEDTAVYYCAKSQSDYDILTGYYYYYGMDVWGKGTLVTVSSGGGGSGGGGSGGGGSQSVLTQPASVSGSPGQSITVSCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1740 - protein, 251 aa, Homo sapiens
QVQLVQSGGGLVQPGGSLRLSCAASGFTVSSNYMSWVRQAPGKGLEWVSAISGSGGSTYYADSVKGRFTISRDNSKNTLYLQMNSLRAEDTAVYYCAKSQSNYDILTGYYYYYGMDVWGKGTLVTVSSGGGGSGGGGSGGGGSSELTQDPAVSVALGRTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1741 - protein, 248 aa, Homo sapiens
GVQLVQSGAEVKKPGSSVKVSCKASGGTFSSYAISWVRQAPGQGLEWMGGIIPIFGTANYAQKFQGRVTITADESTSTAYMELSSLRSEDTAVYYCARMEYDILTGYYGGYFDYWGQGTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1742 - protein, 242 aa, Homo sapiens
QVQLQQSGAEVKKPGSSVKVSCKASGGTFSNYAFSWVRQAPGQGLEWMGGIIPIFGTADYAQKLQGRVTITADELTRTVYMDLSSLRSEDTAVYYCATGMGDHYGMDVWGRGTLVTVSSGGGGSGGGGSGGGGSSELTQDPAVSVALGQTVRITCRGDSLRSYYTNWFQQKPGQAPLLVVYAKNKRPSGIPDRFSGSSSGNTASLTITGAQAEDEADYYCNSRDSSGNHVVFGGGTKLTVLG

SEQ ID NO: 1743 - protein, 245 aa, Homo sapiens
QVQLQQSGAEVKKPGSSVRVSCKASGATFSSHGISWVRQAPGQGLEWMGGIIPIFGTANYAQKLQGRVTITADELTRTVYMDLSSLRSEDTAVYYCATGMGDHYGMDVWGRGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1744 - protein, 247 aa, Homo sapiens
QVQLVQSGAEVKKPGSSVKVSCKTSGGTFSSYAISWVRQAPGQGLEWMGGILPIFGPARYAEKFQGRVTITADELTRTAYMELKTLRSDDTAVYYCARAGTSLMNYGTDVWGKGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1745 - protein, 256 aa, Homo sapiens
QVQLQQSGPGLVKPSETLSLTCTVSGGSISSGNYYWSWVRQHPGKGLEWIGYIYDIGNTYNPSLKSRVTMSVDTSKNQFSLELTSVTAADTAVYYCARVPYYYDTSGGYLGEYYYGMDVWGQGTLVTVSSGGGGSGGGGSGGGGSQSVLTQPASVSGSPGQSITISCTGTSSDVGGYNYVSWYQQHPGKAPKLMIYEGSKWPSGVSNRFSGSKSGNTASLTISGLQAEDEADYYCSSYTTRSTRVFGGGTKLTVLG

SEQ ID NO: 1746 - protein, 247 aa, Homo sapiens
EVQLVQSGAEVKKPGSSVKVSCKTSGGTFSSYAISWVRQAPGQGLEWMGGILPIFGPARYAEKFQGRVTITADELTRTAYMELKTLRSDDTAVYYCARAGTSLMNYGTDVWGQGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1747 - protein, 251 aa, Homo sapiens
EVQLQQSGAEVKKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGQGTLVTVSSGGGGSGGGGSGGGGSQSVLTQPASVSGSPGQSVTISCTGTSSDVGGYNYVSWYQQHPGKAPKLMIYEGSKRPSGVSNRFSGSKSGNTASLTISGPQAEDEADYYCSSYTTRSTRVFGGGTKLTVLG

SEQ ID NO: 1748 - protein, 249 aa, Homo sapiens
EVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHYGMDVWGRGTLVTVSSGGGGSGGGGSGGGGSQSVLTQPASVSGSPGQSITISCTGTSSDVGGYNYVSWYQQHPGKAPKLMIYEGGKRPSGVSNRFSGSKSGNTASLTISGLQAEDEADYYCSSYTTRSTRVFGGGTKLTVLG

SEQ ID NO: 1749 - protein, 251 aa, Homo sapiens
QVQLQQSGAEVKRPGASVVVSCKSSGYTFTKYTMHWVRQAPGQGPEWMGWINGGSGDTKYSRKFQGRVTITKDTSASAAYMELSSLGSEDTALYYCARATYDPLTGYSFDGFDIWGQGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDGADYYCSSYTTRSTRVFGGGTKLTVLG

SEQ ID NO: 1750 - protein, 245 aa, Homo sapiens
QVQLQQSGAEVKKPGSSVKVSCKASGGTFSTYGISWVRQAPGQGLEWMGGIIPMFGTANYAQKLQGRVTITADELTRTVYMDLSSLRSEDTAVYYCATGMGDHYGMDVWGRGTLVTVSSGGGGSGGGGSGGGGSQSVLTQPASVSGSPGQSITISCTGTSSDVGGYNYVSWYQQHPGKAPKLMIYEGSKRPSGASNRFSGSKSGNTASLTISGLQAEDEADYYCSSYTTRSTRVFGGGTELTVLG

SEQ ID NO: 1751 - protein, 247 aa, Homo sapiens
QVQLVQSGAEVKKPGSSVKVSCKASGDTFSSYAISWVRQAPGQGLEWMGGILPIFGTAKYAEKFEDRVTITADELTRTAYMELRRLRSEDTAVYYCARAGSSLMTYGTDVWGRGTMVTVSSGGGGSGGGGSGGGGSQSVLTQPASVSGSPGQSITISCTGTSSDVGGYNYVSWYRQHPGKAPKLMIYEGSKRPSGVSNRFSGSKSGNTASLTISGLQAEDEADYYCSSYTTRSTRVFGGGTKLTVLG

SEQ ID NO: 1752 - protein, 251 aa, Homo sapiens
EMQLVQSGAEVKKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGQGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1753 - protein, 249 aa, Homo sapiens
QVQLQQSGAEVKKPGSSVKVSCKASGGTFSSYAISWVRQAPGQGLEWMGRIIPIGNMANYAQKFQGRVTLTADKSTGTAYMELTSLRSEDTAVYYCARENYDYLTGYYGAFDIWGKGTLVTVSSGGGGSGGGGSGGGGSQSVLTQPASVSVALGQTVTISCTEGDSLRSYYTNWFQQKPGQAPVLVVYAKNNRPSGIPDRFSGSSSGNAASLTITGAQAEDEADYYCNSRDSSGNHVVFGGGTKLTVLG

SEQ ID NO: 1754 - protein, 245 aa, Homo sapiens
QVQLQQSGAEVKKPGSSVKVSCKASGGTFSNYAFSWVRQAPGQGLEWMGGIIPIFGTANYAQKLQGRVTITADELTRTVYMDLSSLRSEDTAVYYCATGMGDHYGMDVWGRGTLVTVSSGGGGSGGGGSGGGGSQSVLTQPPSASGTPGQRVTISCSGSSSNIRSNTVNWYQRLPGAAPQLLIYNNDQRPSGIPDRFSGSKSGTSGSLVISGLQSEDEADYYCASWDDSLNGRVFGGGTKLTVLG

SEQ ID NO: 1755 - protein, 248 aa, Homo sapiens
QVQLQQSGAEVKKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGRGTLVTVSSGGGGSGGGGSGGGGSSELTQDPAVSVALGQTVRITCQGDSLRSYYTNWFQQKPGQAPLLVVYAKNNRPSGIPDRFSGSSSGNTASLTITGAQAEDEADYYCNSRDSSGNHVVFGGGTKLTVLG

SEQ ID NO: 1756 - protein, 251 aa, Homo sapiens
QVQLQQSGAEVKKPGSSVKVSCKASGGTFSNYALNWVRQAPGQGLEWMGGIIPMFGTTRYAQKFQGRVTITADESTTTAYMELSSLRSEDTAVYYCARATYDPLTGYSFDGFDIWGRGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1757 - protein, 245 aa, Homo sapiens
QVQLHQSGAEVKKPGSSVKVSCKASGGTFSNYAFSWVRQAPGQGLEWMGGIIPIFGTANYAQKLQGRVTITADELTRTVYMDLSSLRSEDTAVYYCATGMGDHYGMDVWGRGTMVTVSSGGGGSGGGGSGGGGSQSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLG

SEQ ID NO: 1758 - protein, 251 aa, Homo sapiens
QVQLQQSGAEVKKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGQGTMVTVSSGGGGSGGGGSGGGGSRSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1759 - protein, 254 aa, Homo sapiens
QVQLVQSGGGVVQPGRSLRLSCAASGFTFSSYGMHWVRQAPGKGLEWVAVISYDGSIKYYADSVRGRFTISRDNSKNTLYLQMNSLRAEDTAVYYCAREGSYDILTGYYVGVGRMDVWGRGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1760 - protein, 251 aa, Homo sapiens
QVQLVQSGAEVKKPGASVKVSCKTSGYDFSNYALHWVRQAPGQRLEWMGWINGGNDNTRYAQKYQDRVTITKDTSASAAYMELSSLGSEDTALYYCARATYDPLTGYSFDGFDIWGRGTMVTVSSGGGGSGGGGSGGGGSQSVLTQPASVFGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1761 - protein, 242 aa, Homo sapiens
QVQLQQSGAEVKKPGSSVKVSCKASGGTFSNYAFSWVRQAPGQGLEWMGGIIPIFGTANYAQKLQGRVTITADELTRTVYMDLSSLRSEDTAVYYCATGMGDHYGMDVWGRGTMVTVSSGGGGSGGGGSGGGGSSELTQDPAVSVALGQTVRITCQGDSLRSYYTNWFQQKPGQAPLLVVYAKNKRPSGIPDRFSGSSSGNTASLTITGAQAEDEADYYCHSRDSSGNHVLFGGGTKLTVLG

SEQ ID NO: 1762 - protein, 242 aa, Homo sapiens
QVQLQQSGAEVKKPGSSVKVSCKASGGTFSNYAFSWVRQAPGQGLEWMGGIIPIFGTANYAQKLQGRVTITADELTRTVYMDLSSLRSEDTAVYYCATGMGDHYGMDVWGKGTLVTVSSGGGGSGGGGSGGGGSSELTQGPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1763 - protein, 251 aa, Homo sapiens
EVQVVQSGAEVKKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGQGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1764 - protein, 247 aa, Homo sapiens
QVQLVQSGGGLVKPGGSLRLSCAASGFTFSSYSMNWVRQAPGKGLEWVSSISSSSSYIYYADSVKGRFTISRDNAKNSLYLQMNSLRAEDTAVYYCARDEYDILTGLLQGMDVWGKGTLVTVSSGGGGSGGGGSGGGGSSELTQDPAVSVALGQTVRITCQGDSLRSYYASWYQQKPGQAPVLVIYGKNNRPSGIPDRFSGSGSGNTASLTITGAQAEDEADYYCNSRDSSGNHVVFGGGTKLTVLG

SEQ ID NO: 1765 - protein, 248 aa, Homo sapiens
EVQLVQSGAEVKKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGRGTLVTVSSGGGGSGGGGSGGGGSSELTQDPAVSVALGQTVRITCQGDSLRSYYTNWFQQKPGQAPLLVVYAKNKRPSGIPDRFSGSSSGNTASLTITGAQAEDEADYYCNSRDSSGNHVVFGGGTKLTVLG

SEQ ID NO: 1766 - protein, 247 aa, Homo sapiens
EVTLKESGGGLVKPGRSLRLSCTASGFTFGDYAMSWFRQAPGKGLEWVGFIRSKAYGGTTEYAASVKGRFTISRDDSKNTLYLQMTSLRAEDSAVYYCVRRDILTGFYDSWGRGTTVTVSSGGGGSGGGGSGGGGSQSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLG

SEQ ID NO: 1767 - protein, 247 aa, Homo sapiens
EVQLVHSGAEVKKPGSSVKVSCKASGGTFSNYVISWVRQAPGQGLEWMGRIIPILGTANLAQKFQGRVTITADELTKTAYMELSRLRSEDTAVYYCATGYRNDWYGAFEIWGQGTMVTVSSGGGGSGGGGSGGGGSQSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLG

SEQ ID NO: 1768 - protein, 251 aa, Homo sapiens
EVQLVQSGAEVKKPGASVQVSCKASGYTFTKFTMHWVRQAPGQGPEWMGWINGGSGDTKYSRKFQGRVTITKDTSASAAYMELSSLGSEDTALYYCARATYDPLTGYSFDGFDIWGQGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1769 - protein, 251 aa, Homo sapiens
QVQLQQSGAEVKKPGASVKVSCKASGYTFTKYTMHWMRQAPGQGPEWMGWINGGSGDTKYSRKFQGRVTITKDTSASAAYMELSSLGSEDTALYYCARATYDPLTGYSFDGFDIWGQGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1770 - protein, 247 aa, Homo sapiens
EVQLVQSGAEVKKPGSSVKVSCKTSGGTFSSYAISWVRQAPGQGLEWMGGILPIFGPARYAEKFQGRVTITADELTRTAYMELKTLRSDDTAVYYCARAGTSLMNYGMDVWGRGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1771 - protein, 248 aa, Homo sapiens
QVQLLQSAAEVKKPGSSVKVSCKASGGTFSSYGISWVRQAPGQGLEWMGRISPILGTVNYAQKFQGRVTIIADKSTSTAYMELSSLRSEDTAVYYCARGPYDILTGYYRDAFDIWGRGTMVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKR

SEQ ID NO: 1772 - protein, 252 aa, Homo sapiens
QVQLVQSGAEVKKPGASVKVSCKASGGTFNNHAITWVRQAPGQGLEWMGRVLPFLGATNYAQNFQGRVTFTADRSTSTAYMELSSLRFDDTAVYYCAATHYDILTGYYTADAFDIWGKGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1773 - protein, 258 aa, Homo sapiens
QVQLVQSGPEVKKPGASVKVSCKASGYTFTSDHISWVRQAPGQGLEWMGWISPHHGKTNYAQKLQGRVTMTTDTSTSTAYMELRSLRSDDTAVYYCARVQMDSEYYDLLTGINVGPYYFDYWGQGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1774 - protein, 251 aa, Homo sapiens
EVQLVQSGAEVKKPGASVKVSCKASGYTFTKYTMHWVRQAPGQGPEWMGWINGGSGDTKYSRKFQGRVTITKDTSASAAYMELSSLGFEDTALYYCARATYDPLTGYSFDGFDIWGKGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1775 - protein, 251 aa, Homo sapiens
QVQLQQSGAEVKKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGQGTLVTVSSGGGGSGGGGSGGGGSQSVLTQPASVSGSPGQSITISCTGTSSDVGGYNYVSWYQQHPGKAPKLVIYEGSKRPSGVSNRFSGSKSGNTASLTISGLQAEDEADYYCSSYTTRSTRVFGGGTKLTVLG

SEQ ID NO: 1776 - protein, 251 aa, Homo sapiens
EVQLVQSGAEVKKPGASVKVSCKASGYTFTSYAIHWVRQAPGQRLEWMGWINADNANTKYSQKFQGRVAITRDTSASTAYMELSSLRSEDTAVYYCARATYDPLTGYSFDGFDIWGRGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1777 - protein, 253 aa, Homo sapiens
EVQLVQSGAEVKKPGASVTVSCKASGYTFSTYGITWVRQAPGQGLEWMGWISAYNGDTNYAQELQGRVTMTTDTSTSTAYMELRSLRSDDTAVYYCARGDFGDYDILTGYYPVYYGMDVWGQGTMVTVSSGGGGSGGGGSGGGGSSELTQDPAVSVALGQTVRITCQGGSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1778 - protein, 248 aa, Homo sapiens
QVQLQQSGAEVRKPGASVKVSCKASGYTFTSYGISWVRQAPGHGLEWMGWISAYNGNTNYAQKLQGRVTMTTDTSTSTAYMELRSLRSDDTAVYYCARSYYDILTGYYPFGMDVWGKGTMVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKR

SEQ ID NO: 1779 - protein, 254 aa, Homo sapiens
QVQLQQSGAEVKKPGSSVKVSCKASGGTFSSYGISWVRQAPGQGLEWMGWISAYNGNTNYAQQLQGRVTMTTDTSTSTAYMELRSLRSDDTAVYYCARDLWYYDILTGYYLDDAFDIWGKGTMVTVSSGGGGSGGGGSGGGGSQSVLTQPASVSGSPEQSITISCTGTSSDVGGYNYVSWYQQHPGKAPKLMIYEGSKRPSGVSNRFSGSKSGNTASLTISGLQVEDEADYYCSSYTTRSTRVFGGGTKLTVLG

SEQ ID NO: 1780 - protein, 254 aa, Homo sapiens
QVQLQQSGAEVKKPGSSVKVSCKASGGTFSSYGISWVRQAPGQGLEWMGWISAYNGNTNYAQQLQGRVTMTTDTSTSTAYMELRSLRSDDTAVYYCARDLWYYDILTGYYLDDAFDIWGKGTTVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1781 - protein, 246 aa, Homo sapiens
QVQLQQSGAEVKKPGSSVRVSCKASGGTFNNNAINWVRQAPGQGLEWMGGIIPMFGTAKYSQNFQGRVAITADESTSTASMELSSLRSEDTAVYYCARSRDLLLFPHYGMDVWGRGTLVTVSSGGGGSGGGGSGGGGSSELTQDPAVSVALGQTVRITCQGDSLRGYYASWYQQKPGQAPVLVIYGKNNRPSGIPDRFSGSSSGNTASLTITGAQAEDEADYYCNSRDSSGNHVVFGGGTKLTVLG

SEQ ID NO: 1782 - protein, 248 aa, Homo sapiens
KVQLVESGGGLVQPGGSLRLSCAASGFTFSIYAMSWVRQAPGKGLEWVSAISHNADHTYSADSVKGRFTISRDNSKNTLYLQMNNLRAEDTAIYYCAATRMDVLTRYYSDFWGQGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1783 - protein, 251 aa, Homo sapiens
EVQLVQSGAEVKKPGASVKVSCKASGYTFTKYTMHWVRQAPGQGPEWMGWINGGSGDTKYSRKFQGRVTITKDTSASAAYMELSGLGSEDTALYYCARATYDPLTGYSFDGFDIWGQGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1784 - protein, 251 aa, Homo sapiens
GVQLVQSGAEVKKPGASVKVSCTASEYSFTKYDINWVRQAPGQGLEWMGWINGGSGDTKYSRKFQGRVTITKDTSASAAYMELSSLGSEDTALYYCARATYDPLTGYSFDGFDIWGQGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1785 - protein, 248 aa, Homo sapiens
QVQLQQSGPEVKKPGASVKVSCKASGYTLSHYALHWVRQAPGQRPEWMGTINTGNGDTKYSQKFQGRVTITRDTPASTVNMELSTLTSEDTAVYYCAGGYHDTLTSYNYNWFDPWGKGTLVTVSSGGGGSGGGGSGGGGSSELTQDPAVSVALGQTVRITCQGDSLRSYYTNWFQQKPGQAPLLVVYAKNKRPSGIPDRFSGSSSGNTASLTITGAQAEDEADYYCHSRDSSGNHVVFGGGTKLTVLG

SEQ ID NO: 1786 - protein, 255 aa, Homo sapiens
EVQLVQSGSEVKKPGSSVTVSCKASGGTFGTYGVSWVRQAPGQGLEWMGWISPHHGKTNYAQKLQGRVTMTTDTSTSTAYMELRSLRSDDTAVYYCARAQMDSEYYDLLTGINVGPYYFDYWGQGTMVTVSSGGGGSGGGGSGGGGSSELTQDPAVSVALGQTVRITCQGDSLRSYYTNWFQQKPGQAPLLVVYAKNKRPSGIPGRFSGSSSGNTASLTITGAQAEDEADYYCNSRDSSGNHVVFGGGTKLTVLG

SEQ ID NO: 1787 - protein, 252 aa, Homo sapiens
QVQLVQSGAEVKKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGQGTLVTVSSGGGGSGGGGSGGGGSAQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1788 - protein, 241 aa, Homo sapiens
QVQLQQSGPEVKKPGSSVKVSCKASGGTFSNYAFSWVRQAPGQGLEWMGGIIPIFGTANYAQKLQGRVTITADELTRTVYMDLGSLRSEDTAVYYCATGMGDHYMDVWGRGTLVTVSSGGGGSGGGGSGGGGSSELTQDPAVSVALGQTVRITCQGDSLRSYYTNWFQQKPGQAPLLVVYAKNKRPSGIPDRFSGSSSGNTASLTITGAQAEDEADYYCHSRDSSGNHVLFGGGTKLTVLG

SEQ ID NO: 1789 - protein, 252 aa, Homo sapiens
QVQLQQSGAEVKKPGASVKVSCKASGGTFSNSPINWLRQAPGQGLEWMGSIIPSFGTANYAQRFQGRVTITADESTSTAHMELSSLRSEDTAVYFCAREMGYDILTGYYLNYMDVWGKGTTVTVSSGGGGSGGGGSGGGGSQSVLTQPPSVSGAPGQTVTISCTGTSSDVGGYNYVSWYQQHPGKAPKLMIYEGSKQPSGVSNRFSGSKSGNTASLTISGLQAEDEADYYCSSYTTRSTRVFGGGTKLTVLG

SEQ ID NO: 1790 - protein, 248 aa, Homo sapiens
EVQLVQSGAEVKKPGSSVKVSCKTSGYSFTSYAMHWVRQAPGQGLEWMGKINPSGTSVTYAQRFQGRVTLTRDTSTSTNYMEVNSLRSEDTAVYYCASQHYDILTGYSQEPFDIWGRGTLVTVSSGGGGSGGGGSGGGGSSELTQDPAVSVALGQTVRITCQGDSLRSYYASWYQQKPGQAPVPVIYGKNNRPSGIPDRFSGSSSGNTASLTITGAQAEDEADYYCNSRDSSGNHVVFGGGTKLTVLG

SEQ ID NO: 1791 - protein, 256 aa, Homo sapiens
EVQLVQSGGVVVQPGGSLRLSCAASGFTFSNDWMTWVRQAPGKGLEWVGRIKSKTDGGTTDYAAPVKGRFTISRDDSKNTLYLQMNSLKTEDTAVYYCTTFNPTYDILTGYYIGGYFQHWGRGTLVTVSSGGGGSGGGGSGGGGSQSVLTQPPSASGSPGQSVTISCTGTSSDVGGYNYVSWYQQHPGKAPKFMIYDVSKRPSGVSNRFSGSKSGNTASLTISGVQAEDEADYYCSSYTSASTVIFGGGTKLTVLG

SEQ ID NO: 1792 - protein, 251 aa, Homo sapiens
EVQLVQSGAEVKKPGASVKVSCRASGYTFTKYTMHWVRQAPGQGPEWMGWINGGSGDTKYSRKFQGRVTITKDTSASAAYMELSSLGSEDTALYYCARATYDPLTGYSFDGFDIWGQGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1793 - protein, 251 aa, Homo sapiens
QVQLQQSGAEVKKPGASVKVSCKASGYTFTKYTMHWVRQAPGQGPEWMGWVNGGSGDTKYSRKFQGRVTITKDTSASAAYMELSSLGSEDTALYYCARATYDPLTGYSFDGFDIWGQGTLVTVSSGGGGSGGGGSGGGGSQSVLTQPASVSGSPGQSITISCTGTSSDVGGYNYVSWYQQHPGKAPELMIYEGSKRPSGVPNRFSGSKSGNTASLTISGLQAEDEADYYCSSYTTRSTRVFGGGTKLTVLG

SEQ ID NO: 1794 - protein, 245 aa, Homo sapiens
QVQLQQSGAEVKKPGSSVKVSCKASGGTFSNYAFSWVRQAPGQGLEWMGGIIPIFGTANYAQKLQGRVTITADELTRTVYMDLSSLRSEDTAVYYCATGMGDHYGMDVWGRGTLVTVSSGGGGSGGGGSGGGGSQSVLTQPPSASGTPGQRVTISCSGSSSNIGSNTVNWYQRLPGAAPQLLIYNNDQRPSGIPDRFSGSKSGTSGSLVISGLQSEDEADYYCASWDDGLNGRVFGGGTKLTVLG

SEQ ID NO: 1795 - protein, 251 aa, Homo sapiens
QVQLQQSGAEVKKPGASVKVSCKASGYTFAKYTMHWVRQAPGQGPEWMGWINGGSGDTKYSRKFQGRVTITKDTSASAAYMELSSLGSEDTALYYCARATYDPLTGYSFDGFDIWGQGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1796 - protein, 254 aa, Homo sapiens
EVQLVESGGGVVQPGRSLRLSCAASGFTFRNYGMHWVRQAPGKGLEWVAVISYDGRIKNYGDSVKGRFTGSRDNSKNTLYLEMNSLRPEDTAVYYCATEVRNYDLLTRSYLAGPLDNWGRGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1797 - protein, 250 aa, Homo sapiens
QVQLVQSGGGLVQPGRSLRLSCTASGFTFGDYAMSWVRQAPGKGLEWVGFIRSKAYGGTTEYAASVKGRFTISRDDSKSIAYLQMNSLKTEDTAVYYCTTQYYDILTGYELDIWGRGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1798 - protein, 251 aa, Homo sapiens
EVQLVQSGAEVKKPGATVKVSCKVSGFTFTKYTMHWVRQAPGQGPEWMGWINGGSGDTKYSRKFQGRVTITKDTSASAAYMELSSLGSEDTALYYCARATYDPLTGYSFDGFDIWGQGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1799 - protein, 258 aa, Homo sapiens
QVQLQQSGPGLVKPSQTLSLSCAISGDSVSSNSAAWNWIRQSPSRGLEWLGRTYYRSKWYNDYAVSVKSRMTINPDTSRNQFSLQLNSVTPEDTAVYYCAREGAHYDILTGHNYYHYGMDVWGKGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1800 - protein, 251 aa, Homo sapiens
GVQLVQSGAEVKKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGQGTMVTVSSGGGGSGGGGSGGGGSQSVLTQPPSASGTPGQRVTISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1801 - protein, 251 aa, Homo sapiens
QVQLQQSGAEVKKPGASVKVSCKASGYTFTKYTMHWVRQAPGQGPEWMGWINGGSGDTKYSRKFQGRVTITKDTSASAAYMELSSLGSEDTALYYCARATYDPLTGYSLDGFDIWGQGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1802 - protein, 251 aa, Homo sapiens
QVQLVQSGAEVKKPGASVKVSCKASGYSFTSYAMHWVRQAPGQGLEWMGKINPSGTSVTYAQRFQGRVTLTRDTSTSTNYMEVNSLRSEDTAVYYCASQHYDILTGYSQEPFDIWGRGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1803 - protein, 251 aa, Homo sapiens
EVQLVQSGAEVKKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGQGTLVTVSSGGGGSGGGGSGGGGSQSALTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1804 - protein, 250 aa, Homo sapiens
QVQLQQSGAEVKKPGSSVKVSCKASGGTFSSYAISWVRQAPGQGLEWMGRIIPIVNMANYAQKFQGRVTLTADKSTGTVYMELTSLRSEDTAVYYCARENYDFLTGYYGAFDIWGKGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1805 - protein, 251 aa, Homo sapiens
QVQLQQSGAEVKKPGASVKVSCKVSGYSLTKYTMHWVRQAPGQGPEWMGWINGGSGDTKYSRKFQGRVTITKDTSASAAYMELSSLGSEDTALYYCARATYDPLTGYSFDGFDIWGKGTMVTVSSGGGGSGGGGSGGGGSQSVLTQPPSASGTPGQRVTISCSGSSSNIGSNTVNWYQRLPGAAPQLLIYNNDQRPSGIPDRFSGSSSGNTASLTITGAQAEDEADYYCNSRDSSGNHVVFGGGTKLTVLG

SEQ ID NO: 1806 - protein, 251 aa, Homo sapiens
EVQLVQSGAEVKKPGASVKVSCKASGYTFTGYYMHWVRQAPGQGLEWMGWINPNSGGTNYAQKFQGRVTMTRDTSISTIYMELSSLGSEDTALYYCARATYDPLTGYSFDGFDIWGRGTLVTVSSGGGGSGGGGSGGGGSQSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLG

SEQ ID NO: 1807 - protein, 251 aa, Homo sapiens
EVQLVQSGAEVKKPGASVKVSCKASGYTFTSYAMHWVRQAPGQRLEWMGWINAGSGDTKYSRKFQGRVTITKDTSASAAYMELSSLGSEDTALYYCARATYDPLTGYSFDGFDIWGRGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1808 - protein, 251 aa, Homo sapiens
QVQLVQSGAEVKKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGKGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1809 - protein, 251 aa, Homo sapiens
QVQLVQSGAEVKKPGSSVKVSCKASGGTFGSHTISWVRQAPGQGLEWMGGIIPKYSAPKYAQEFQGRVTMTRDTSISTAYMELSRLRSDDTAVYYCARGEYDILTGYPYWYFDLWGRGTLVTVSSGGGGSGGGGSGGGGSQSVLTQPPSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLG

SEQ ID NO: 1810 - protein, 251 aa, Homo sapiens
EVQLVQSGAEVKKPGASVKVSCKASGYTFTKYAMHWVRQAPGQGPEWMGWINGGSGDTKYSRKFQGRVTITKDTSASAAYMELSSLGSEDTALYYCARATYDPLTGYSFDGFDIWGQGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGPQAEDEADYYCSSYTTRSTRVFGGGTKLTVPG

SEQ ID NO: 1811 - protein, 251 aa, Homo sapiens
QVQLQQSGAEVKKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGKGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1812 - protein, 251 aa, Homo sapiens
QVQLQQSGAEVRRPGASVRVSCRASGYTFTNYAIHWIRQAPGQRLEWMGWINAANGVTNYSDDFQDRVTLTRDTSARTAYMELSSLGSEDTALYYCARATYDPLTGYSFDGFDIWGRGTLVTVSSGGGGSGGGGSGGGGSQSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLG

SEQ ID NO: 1813 - protein, 253 aa, Homo sapiens
EVQLVQSGAEVKKPGSSVRVSCKASGGTFSNYAINWVRQAPGQGLEWMGGIIPMFGTTRYAQKFQGRVTITADESTSTAYMELSSLRSEDTAVYYCARDGSYDILTGYYIDNYMDVWGRGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1814 - protein, 253 aa, Homo sapiens
QVQLVQSGGSLVQPGGSLRLSCAASGFTVSSNYMSWVRQAPGKGLEWVSVIYSGGSTYYADSVKGRFTISRDNSKNTLYLQMNSLRAEDTAVYYCARGEGGYDILTGYLRGYGMDVWGQGTQVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1815 - protein, 245 aa, Homo sapiens
QVQLQQSGAEVKKPGSSVKVSCKASGGTFSNYAFSWVRQAPGQGLEWMGGIIPIFGTANHAQKLQGRVTITADELTRTVYMDLSSLRSEDTAVYYCATGMGDHYGMDVWGRGTLVTVSSGGGGSGGGGSGGGGSQSVLTQPLSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLG

SEQ ID NO: 1816 - protein, 248 aa, Homo sapiens
QVQLQQSGAEVKKPGSSVKVSCKASGGTFNMFSVSWLRQAPGQGLEWMGSIIPLLGSTNYAQKFQGRITITADDPMTTAYMELSSLKSEDTALYYCARATYDPLTGYSFDGFDIWGQGTLVTVSSGGGGSGGGGSGGGGSSELTQDPAVSVALGQTVRITCQGDSLRSYYTNWFQQKPGQAPLLVVYAKNKRPSGIPDRFSGSSSGNTASLTITGAQAEDEADYYCNSRDSSGNHVVFGGGTKLTVLG

SEQ ID NO: 1817 - protein, 249 aa, Homo sapiens
QVQLVQSGGGLVQPGGSLRLSCAASGFTFSSYEMNWVRQAPGKGLEWVASIKEDGTDKYYVESVRGRFGISRDNAKNSLSLQMNSLRVEDTAVYYCARGSYYDILTGISSLGMDVWGKGTTVTVSSGGGGSGGGGSGGGGSSELTQDPAVSVALGQTVRITCQGDSLRSYYTNWFQQKPGQAPLLVVYAKNKRPSGIPDRFSGSSSGNTASLTITGAQAEDEADYYCHSRDSSGNHVLFGGGTKLTVLG

SEQ ID NO: 1818 - protein, 246 aa, Homo sapiens
QVQLQQSGAEVKKPGSSVRVSCKASGGTFNNNAINWVRQAPGQGLEWMGGIIPMFGTAKYSQNFQGRVAIIADESTSTASMELSSLRSEDTAVYYCARSRDLLLFPHYGMDVWGKGTMVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1819 - protein, 255 aa, Homo sapiens
EVQLVESGGGLVKPGGSLRLSCAASGFTFSDYYMSWIRQAPGKGLEWVSYISSSSSYTNYADSVKGRFTISRDNAKNSLYLQMNSLRAEDTAVYYCARDRGHYDILTGYYIEPSGFDYWGKGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1820 - protein, 245 aa, Homo sapiens
EVQLVESGGGLVQPGGSLRLSCAASGFSFSDYYMDWVRQVPGKGLEWLGRTKNKGYTTQYAASVKGRFSISRDDLTNLLFLQLNGLKTEDTAIYYCARGPGVIGNYDYWGRGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1821 - protein, 252 aa, Homo sapiens
GVQLVESGGGLVQPGGSLRLSCAASGITFTNAWMSWVRQAPGKGLEWLGRVKSKVDGGTVDYAAPVKGRFTISRDDLINTLFLQINSLKAEDTGVYYCTTGGMIRAREDYYYMDVWGKGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1822 - protein, 251 aa, Homo sapiens
GVQLVQSGAEVKKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGQGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1823 - protein, 248 aa, Homo sapiens
QVQLQQSGAEVKKPGASVKVSCKASGYAFTKYTMHWVRQAPGQGPEWMGWINGGSGDTKYSRKFQGRVTITKDTSASAAYMELSSLGSEDTALYYCARATYDPLTGYSFDGFDIWGRGTLVTVSSGGGGSGGGGSGGGGSSELTQDPAVSVALGQTVRVTCQGDSLRSYYTNWFQQKPGQAPLLVVYAKNKRPSGIPDRFSGSSSGNTASLTITGAQAEDEADYYCNSRDSSGNHVVFGGGTKLTVLG

SEQ ID NO: 1824 - protein, 251 aa, Homo sapiens
KVQLVQSGAEVKKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGQGTMVTVSSGGGGSGGGGSGGGGSQSVPTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1825 - protein, 251 aa, Homo sapiens
GVQLVQSGAEVKKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGQGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1826 - protein, 245 aa, Homo sapiens
QVQLVQSGGGLVQPGGSLRLSCAASGFSFSSHSMNWVRQAPGKGLEWVSYIDSSSSTIHYADSVKGRFIISRDNAKNSLYLQMNSLRAEDTAVYYCASTYYDILTGYYFDYWGQGTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1827 - protein, 251 aa, Homo sapiens
GVQLVQSGAEVKKPGASVKVSCKASGYTFTKYTMHWVRQAPGQGPEWMGWINGGSGDTKYSRKFQGRVTITKDTSASAAYMELSSLGSEDTALYYCARATYDPLTGYSFDGFDIWGQGTLVTVSSGGGGSGGGGSGGGGSQSVLTQPASMSGSPGQSITISCTGTSSDVGGYNYVSWYQQHPGKAPKLMIYEGSKRPSGVSNRFSGSKSGNTASLTISGLQAEDEADYYCSSYTTRSTRVFGQGTKLEIKR

SEQ ID NO: 1828 - protein, 255 aa, Homo sapiens
QVQLVQSGAEVKKPGSSVKVSCKVSGGTFSSYTISWVRQAPGQGLEWMGRIIPIHGIVNHAEKFQGRATITADKSTSTAYMELSSLRSEDTAVYYCARLPPYDMLTGYYVGGGMDVWGRGTMVTVSSGGGGSGGGGSGGGGSAQAVLTQPSSVSGAPGQRVTISCTGSRSNIGAGFDIHWYQQLPGTAPKLLIYSNDIRPSGVPDRFSGSRSGTSASLAITGLQAEDEADYYCQSYDSSLSGYVFGTGTKLTVLG

SEQ ID NO: 1829 - protein, 253 aa, Homo sapiens
QVQLVQSGAEVKKPGSSVKVSCRASGGTLTSYTITWVRQAPGQGLEWMGGIIPRFDAADYAQKFQGRLTIAADELTNTVHMELSSLTSEDTGVYFCARAKPYTDFSRGSDADAFDVWGRGTMVTVSSGGGGSGGGGSGGGGSALSSELTQDPAVSVALGQTVRITCQGDSLRSYYASWYQQKPGQAPVLVIYGKNNRPSGIPDRFSGSSSGNTASLTITGAQAEDEADYYCNSRDSSGNHLVFGGGTKLTVLG

SEQ ID NO: 1830 - protein, 242 aa, Homo sapiens
QVQLVQSGAEVKKPGSSVKVSCKASGGTVSSRTISWVRQAPGQGLEWMGGSLPPSGAPIYAQKFQGRVAITADALTNTAFMELRSLKSDDTAVYYCARDQGRYLDLWGKGTLVTVSSGGGGSGGGGSGGGGSALPVLTQPPSASVAPGQTARIACGGNNIGSQAVHWYQQKPGQAPVLVVYDDSDRPSGIPERISGSKSGNTATLTISRVEAGDEADFYCQVWDGSSDHWVFGGGTKLTVLG

SEQ ID NO: 1831 - protein, 251 aa, Homo sapiens
QVQLVQSGAEVKKPGSSVKVSCKASGGTFSSYAFNWVRRAPGQGLEWLGSIVPVFNTKTFARKFQGRVTLTADELTRTAYLELSNLRSDDTAVYYCASRYGDPFYYYYYMNVWGQGTLVTVSSGGGGSGGGGSGGGGSAQAVLTQPSSVSGAPGQRVTISCTGSSSNIGKGYDVHWYQQLPGKAPKLLMYDNNNRPSGVPDRFSGSKSGTSASLAITGLQAEDEADYYCQSYDSNLSGYVFGTGTQLTVLS

SEQ ID NO: 1832 - protein, 251 aa, Homo sapiens
QVQLVQSGAEVKKPGSSVKVSCRASGGSFNHAISWVRQAPGRGLEWMGGILPMYGTANYAQKFQGRVTITADKLTNTVYMDLSRLRYEDTAVYYCARELGLSIVGATTGALDMWGRGTLVTVSSGGGGSGGGGSGGGGSAQSVLTQPPSASGTPGQRVTISCSGSSSNIGSNTVNWYQQLPGTAPKLLIYSNNRRPSGVPERFSGSKSGTSASLAISGLQPEDEADYYCAAWDDSLKGWVFGGGTKLTVLG

SEQ ID NO: 1833 - protein, 251 aa, Homo sapiens
QVQLVQSGAEVKKPGSSVKVSCRASGGTFSGYTVNWVRQAPGQGLEWMGRINPMSNGANYAQKFQGRVTITADKSTSTAYLDLSSLRSEDTAMYYCARGGYDILTQYPAEFFHPWGQGTLVTVSSGGGGSGGGGSGGGGSALSSELTQDPAVSVALGQTVTITCQGDSVRNFYASWYQQKPGQAPLLVIYGQNNRPSGIPDRFSGSRSGNTASLTITGAQAEDEGVYYCNSRDSSTNPVVFGGGTKVTVLG

SEQ ID NO: 1834 - protein, 246 aa, Homo sapiens
EVQLVQSGAEVKKPGSSVKVSCKASGGTVSSRTISWVRQAPGQGLEWMGGSLPPSGAPIYAQKFQGRVAITADALTNTAFMELRSLKSDDTAVYYCARDQGRYLDLWDQGTLVTVSSGGGGSGGGGSGGGGSAQAVLTQPSSVSGAPGQRVTISCTGSSSNIGAGYDVHWYQHLPGTAPKLLIYGNKNRPSEIPDRFSGSKSGTSASLAITGLQPEDEADYYCQSYDSSLSGPVAFGGGTKVTVLG

SEQ ID NO: 1835 - protein, 253 aa, Homo sapiens
EVQLVESGGGLIQPGGSLRLSCAASGFTLNNFGMNWVRQAPGKGLEWVSYISYSSSTKYYADSVKGRFTISRDIGKNSLYLQMNNLRAEDTAVYYCARDRYYDILTKGDYYYGMDVWGRGTLVTVSSGGGGSGGGGSGGGGSALSSELTQDPAVSVALGQTVRITCQGDSLRSYYASWYQQKPGQAPVLVIYGKNNRPSGIPDRFSGSSSGNTASLTITGAQAEDEADYYCNSRDSSGNLVVFGGGTKVTVLG

SEQ ID NO: 1836 - protein, 262 aa, Homo sapiens
EVQLVQSGAEVKKPGASVKVSCKASGYTFAANYIHWVRQAPGQGLEWMGWINPNTGATKFSRKFEGRVTMTRDTSITTVYMDLNRVRFDDTAVYYCARVQGETYYDILTGYWGPKRDLYGMDVWGRGTMVTVSSGGGGSGGGGSGGGGSAQAVLTQPSSVSGAPGQRVTISCTGSNSNIGAGYDVHWYQQLPGTAPKLLIYNDSNRPSGVPDRFSGSKSGTSASLAITGLQAEDEAHYYCQSYDNSLSASIFGGGTKLTVLG

SEQ ID NO: 1837 - protein, 251 aa, Homo sapiens
EVQLVQSGAEVKKPGSSVKVSCKASGGSFNHAIICWLQAPGRGLEWMVGILPMYGTANYAQKFQGRVTITADKLAITAYMDLIRLRYEDTAVYYCARELGLSIVVATTGALDMWGRGTLVTVSSGGGGSGGGGSGGGGSAQSVVTQPPSVSAAPGQKVIISCSGSSSNIGTNSVSWYQQLPGTAPKLLIYDNNKRPSGIPDRFSGSKSGTSATLGITGLQSGDEADYYCGTRDSSLSAVVFGGGTQLTVLS

SEQ ID NO: 1838 - protein, 249 aa, Homo sapiens
QVQLQQSGAEVKKPGSSVKVSCKASGGTFNNFAFSWVRQAPGQGLEWMGGITPLFGTPNYAERLQGRVTITADELTRTVYMELSSLRSEDTAVYYCARESEGGDYTNPFGYWGRGTTVTVSSGGGGSGGGGSGGGGSAQAVVIQEPSLTVSPGGTVTLTCTSSTGAVTNNNYPSWFQQKPGQAPRPLISWTNNRPSWTPARFSAYLLGGKAVLTLSGVQPEDEAEYYCLLYSGDAQLVFGGGTKVTVLG

SEQ ID NO: 1839 - protein, 245 aa, Homo sapiens
QVQLVQSGAEVKKPGSSVKVSCKASGGTVSSRTISWVRQAPGQGLEWMGGSLPPSGAPIYAQKFQGRVAITADALTNTAFMELRSLKSDDTAVYYCARDQGRYLDLWGKGTMVTVSSGGGGSGGGGSGGGGSAQAVLTQPSSVSGAPGQRVTISCTGSSSNIGAGYDVHWYQQLPGTAPKLLIYGYINRPSGVPDRFSGSKSGTSASLAITGLQAEDEADYYCQSYDTSLSDYVFGTGTKVTVLG

SEQ ID NO: 1840 - protein, 251 aa, Homo sapiens
DVQLLQSGAEVKKPGSSVKVSCRASGGSFNHAISWLRQAPRRGLEWMGGILPMYGTAYYAQKFQGRVTITADKLTNTVYMDLSRLRYEDTAVYYCARELGLSIVGATTGALDMWGRGTLVTVSSGGGGSGGGGSGGGGSAQSVVTQPPAVSAAPGQKVTISCSGSSSNIGSYYVSWYQQLPGTAPKLLIYDNDKRPSGIPDRFSVSKSGTSSTLAITGLQTGDEADYYCGTWDSSLSAGVFGGGTKVTVLG

SEQ ID NO: 1841 - protein, 258 aa, Homo sapiens
EVQLVETGGGLVKPGGSLRLSCAASGFTFSGYSMNWVRLAPGKGLEWVASIRSRSGGTYIYYADSVKGRFTISRDNAKNSLYLQMNSLRAEDTAVYYCARDPGNYDILTGYYYYYGMDVWGQGTLVTVSSGGGGSGGGGSGGGGSAQAVLTQPSSVSGAPGQRVTIPCTGSSSNIRAGYDVHWYQQLPGTAPRLLIYGNSNRPSGVPDRFSGSKSGTSASLAITGLQAEDEADYYCQSYDTNLSGWVFGGGTKLTVLG

SEQ ID NO: 1842 - protein, 244 aa, Homo sapiens
EVQLVQSGSEVEKPGSSVKVSCKASGGTFSSHALSWVRQAPGQGLEYMGGIMPGFGKSSYAPKFLGRLTITADDLTNTGYMELTSLTSDDTAVYYCATVRLPHHHYFMAVWGQGTLVTVSSGGGGSGGGGSGGGGSAQSVLTQPPSVSVSPGQTAIITCSGNKLGNKYATWYQQKPGQPPVAVIYEDNKRPSGIPERFSGSNSGDTATLTISGTQAMDEADYYCQAWDSDTVVFGGGTKVTVLG

SEQ ID NO: 1843 - protein, 254 aa, Homo sapiens
QVQLVQSGAEVKKPGSSVKVSCTASGGIFSSSTFSWVRQVPGQGLEWLGGITPMFAKADYAQKFQGRVAITADELTRTVYMDLSGLRPEDTAIYYCARESSITVNPPYYFYGMDVWGRGTMVTVSSGGGGSGGGGSGGGGSALSYVLTQPPSVSKGLRQTATLTCTANTNNVGSHGATWLQHRQGHPLKLLVYRDEKRPSGISERLSASRSGDTASLTITGLQPEDEADYYCAAWDSGLSAWVFGGGTKLTVLG

SEQ ID NO: 1844 - protein, 242 aa, Homo sapiens
EVQLVQSGAEVKKPGSSVKVSCKASGGTVSSRTISWVRQAPGQGLEWMGGSLPPSGAPIYAQKFQGRVAITADALTNTAFMELRSLKSDDTAVYYCARDQGRYLDLWGKGTLVTVSSGGGGSGGGGSGGGGSALETTLTQSPATLSVSPGESATLSCRASQSFSNNLAWYQQKPGQGPRLLIYGASTRATGIPARFSGSGSGTEFTLTIISLQSEDFAVYYCQQYYDWPITFGRGTRLEIKR

SEQ ID NO: 1845 - protein, 244 aa, Homo sapiens
EVQLVQSGAEVKKPGSSVKVSCKASGGTVSSRTISWVRQAPGQGLEWMGGSLPPSGAPIYAQKFQGRVAITADALTNTAFMELRSLKSDDTAVYYCARDQGRYLDLWGRGTLVTVSSGGGGSGGGGSGGGGSALSYVLTQPPSASGTPGQRVTISCSGSSSNLGINTVNWYQQVPGTAPKLLIYSDHQRPSGVPDRFSGSKSATSASLAISGLQSEDEADYYCAAWDDSLNGVFGGGTKLTVLG

SEQ ID NO: 1846 - protein, 254 aa, Homo sapiens
QVQLVQSGAELKKPGASVKVSCQASGYTITGYYVHWVRQAPGQGLEWMGWINPSTGGTKYAQKFQGRVTMTRDTSINSAYMELTRLTSDDTAVYYCARSPEGDYQPLSSNYNWLDPWGQGTLVTVSSGGGGSGGGGSGGGGSAQSVLTQPPSASGTPGQRVTISCSGSDSNIGSYAVNWYQQLPGTAPKLLMSSNSHRSSGVPDRFSGSKSGTSASLAISGLQPEDEADYYCAAWDDTLSGRVFGGGTQLAVLS

SEQ ID NO: 1847 - protein, 246 aa, Homo sapiens
QLQLQESGPGLVRPSGTLSLACSVSGDSISNNNWWTWVRQSPRKGLEWIGEINHSGTTNYNPSLKTRVSISADRSRDHLSLELKSVTAADTAVYFCATGKEGYNDNWGRGTMVTVSSGGGGSGGGGSGGGGSAQAVLTQPSSVSGAPGQRVTISCTGSSSNIGADYDVHWYQQLPGTAPRLLIYGNNNRPSGVPDRFSGSKSGTSASLAITGLQAEDEADYYCQSYDSSLSGSRVFGTGTKLTVLG

SEQ ID NO: 1848 - protein, 253 aa, Homo sapiens
EVQLVQSGADVRKPGASVKVSCKASGYNFMNYDINWVRQAPGEGLEWMGWMNPKSGKTDSAEKFEGRVTMTTDTSRDTVYMELSRLRSDDTAVYFCARGSGYDLLTGYFTGSPLDYWGQGTLVTVSSGGGGSGGGGSGGGGSALSSELTQDPAVSVALGQTVRITCQGDSLRKYYESWYQQKPGQAPVILLYYKNGRPSGMPDRFSASRSGNTATLTITGAQAEDEADYYCNSRDNSGTDLIFGGGTKLTVLG

SEQ ID NO: 1849 - protein, 255 aa, Homo sapiens
QMQLVQSGAELKKPGASVKVSCQASGYTITGYYVHWVRQAPGQGLEWMGWINPSTGGTKYAQKFQGRVTMTRDTSINSAYMELTRLTSDDTAVYYCAGSPEGDYQPLSSNYNWLDPWGKGTLVTVSSGGGGSGGGGSGGGGSAQAVLTQPSSVSGAPGQRVTISCTGSTTNIGAGFAVHWYQQLPGAAPKLIIYGNRNRPSGVPDRFSGSKSGTSASLAISGLQSGDEADYYCAAWDDSLKAVVFGGGTQLTVLS

SEQ ID NO: 1850 - protein, 253 aa, Homo sapiens
EVQLVQSGAEVKKPGASLKVSCKASGYTFTNYGLHWVRQTPGQGLEWLGWISAYNGNTYYSQKLQDRVTLTTDTSTSTVSMELRGLRSDDTAVYYCARMGHYDILTGYRHYGMDVWGRGTLVTVSSGGGGSGGGGSGGGGSAQAVLTQPSSASGTPGQRVTISCSGGGSNIGSNSANWYRQVPGAAPELVIYSNNQRPSAVPDRFSGSKSGTSASLVIRGLRSEDEAEYYCATWDDSLRGVVFGGGTKVTVLG

SEQ ID NO: 1851 - protein, 250 aa, Homo sapiens
QVQLQESGGDLVQPGGSLRLSCVASGFTFSSYWMYWVRQAPGKGLVWVSRIKSDGSGTEYEDSVKGRFTISRDNAKNTLYLQMKSLRTEDTAVYYCARGNYDILTGYPHDLWGKGTMVTVSSGGGGSGGGGSGGGGSALSYELTQPPSASGTPGQRVTISCSGSISNIGSNIVNWYQQFPGMAPKILIQNNSQRPSGVPDRFSGSKSGTSASLAISGLQSEDEAQYYCAAWDDSLNGRVFGTGTKVTVLG

SEQ ID NO: 1852 - protein, 252 aa, Homo sapiens
QVQLVQSGPEVKKPGASVKVSCKASGYSFSTHGITWVRQAPGQGLEWMGWISGYNGNTNFAQKVQGRVTMTTDTSTSTAYMELRSLRSDDTAVYFCARSYYDILTGYYHTPLDYWGRGTLVTVSSGGGGSGGGGSGGGGSAQSVLTQPPSASGTPGRRVTISCSGNDSNVARNSVNWYQQLPGAAPKLLIYSDDRRPSGVPDRFSGSKSGTSASLAISGLQSEDEAHYYCGAWDDSLSGLVFGGGTKVTVLG

SEQ ID NO: 1853 - protein, 253 aa, Homo sapiens
QVQLVQSGADVKKPGASVKVSCKASGYNFMNYDINWVRQAPGEGLEWMGWMNPKSGKSDSAEKFEGRVTMTTDTSRDTVYMELSRLRSDDTAVYFCARGSGYDLLTGYFTGSPLDYWGQGTLVTVSSGGGGSGGGGSGGGGSALSSELTQDPAVSVALGQTVRITCQGDSLRKYYTNWFQQRPGQAPLLVMYGQHNRPSGIPDRFSGSRSGNTASLTITGTQAEDEADYYCNSRDSSGTVLIFGGGTKLTVLG

SEQ ID NO: 1854 - protein, 254 aa, Homo sapiens
EVQLVQAGAEVKKPGATAKVSCKTSGYSFDNYGIAWVRQAPGQGLEWMGWISAYDGDRNYAQKLRGRVTMTTDTSTSTAYMELRSLRPDDTAVYYCARDDRDILTNYYLEYFQHWGQGTMVTVSSGGGGSGGGGSGGGGSAQSVLTQPPSVSGSPGQSVTISCAGTSSNIGPYNYVSWYQQHPGQAPKLIIYEVTKRASGVPARFSGSKSGNTASLTVSGLQSEDEADYYCSSSIGNFNLGVVFGGGTKLTVLG

SEQ ID NO: 1855 - protein, 256 aa, Homo sapiens
EVQLVQSGADVKKPGASVKVSCKTSGYNFMNYDINWVRQAPGEGLEWMGWMNPNSGKTDSAEKFQGRVTMTTDSSRDTVYMELSRLRSDDTAVYFCARGSGYDVLTGYFTGSPLDYWGRGTMVTVSSGGGGSGGGGSGGGGSAQSVLTQPPSVSGTPGQRVTISCSGSSSNIGSNFVSWYQQFPGTAPKLLIYRNNQRPSGVPDRFSGSKSGTSASLAITGLQVDDEADYYCQSYDASLSGRGVVFGGGTKLTVLG

SEQ ID NO: 1856 - protein, 249 aa, Homo sapiens
EVQLVESGGGLVQPGGSLRLSCAASGFTFSSYSMNWVRQAPGKGLEWVSSISSSSSYIYYADSVKGRFTISRDNAKNSLYLQMNSLRAEDTAVYYCARGRYDILTGYFTSFDYWGQGTLVTVSSGGGGSGGGGSGGGGSALSSELTQDPAVSVALGQTVRITCQGDSLRSSYASWYQQKPGQAPTLVIFGKNNRPSGIPDRFSGSSSGNTASLTITGAQAEDEADYYCNSRDSSGNLPFGGGTKVTVLG

SEQ ID NO: 1857 - protein, 254 aa, Homo sapiens
EVQLVQSGAEVKKPGATVKVSCKTSGYSFDNYGIAWVRQAPGQGLEWMGWISAYDGDRNYAQKLRGRVTMTTDTSTSTAYMELRSLRPDDTAVYYCARDDRDILTNYYLEYFQHWGQGTMVTVSSGGGGSGGGGSGGGGSAQSVLTQPPSVSGSPGQSVTISCAGTSSNIGPYNYVSWYQQHPGQAPKLIIYEVTKRASGVPARFSGSKSGNTASLTVSGLQSEDEADYYCSSSIGNFNLGVVFGGGTKLTVLG

SEQ ID NO: 1858 - protein, 253 aa, Homo sapiens
QMQLVQSRAEVKKPGASVKVSCEASAELFASSDINWVRRATGQGLEWMGWVNPSSGNAGYAEKFEGRVSMTTNIPKKTVYMELSSLTSEDTAVYYCARGTGYDILTGYYMGSAFDQWGQGTMVTVSSGGGGSGGGGSGGGGSALSSELTQDPDVSVALGQTVRITCQGDSLRSYYPSWYQQKPGQAPVLVIFGKNNRPSGIPDRFSGSSSGNTAFLTITGAQAEDEGDYYCNSRDSTRSHLVFGGGTQLTVLS

SEQ ID NO: 1859 - protein, 253 aa, Homo sapiens
QVQLVQSGAEVKKPGASVKVSCKASGYTFTNYGIHWVRQAPGQGLEWLGWISAYNGNTYYSQKLQDRVTLTTDTSTSTAYMELRSLRSDDTAVYYCARMGHYDILTGYRHYGMDVWGKGTMVTVSSGGGGSGGGGSGGGGSAQSVLTQPPSVSAAPGQRVTISCSGGSSNIGKNYVSWYQQLPGTAPKLLIYDNYKRPSGIPDRFSGSKSATSATLGITGLQTGDEADYYCGTWDSSLSALVFGGGTKLTVLG

SEQ ID NO: 1860 - protein, 245 aa, Homo sapiens
QVQLVQSGAEVKKPGSSVKVSCKASGGTVSSRTISWVRQAPGQGLEWMGGSLPPSGAPIYAQKFQGRVAITADALTNTAFMELRSLKSDDTAVYYCARDQGRYLDLWGQGTLVTVSSGGGGSGGGGSGGGGSALPVLTQPPSASGTPGQRVTISCSRTTSNFGSNTVNWYQQSPGTAPKLLIFSNNQRPSGVSDRFSGSKSGASASLAISGLQSADEAEYYCAAWDNSLNGFLSFGGGTKVTVLG

SEQ ID NO: 1861 - protein, 252 aa, Homo sapiens
QVQLVQSGAEVKKPGSSVKVSCRASGGSFNHAISWVRQAPGRGLEWMGGILPMYGTANYAQKFQGRVTITADKLTNTVYMDLSRLRYEDTAVYYCARELGLSIVGATTGALDMWGRGTLVTVSSGGGGSGGGGSGGGGSAQAVLTQPSSVSGAPGQKVTISCTGTNSNLGAPYGVQWYQQLPGKAPRLLIYDDNIRPSGIPDRFSGSQSGTSVSLAITGLQADDEADYYCQSFDSGLSGSIFGGGTKLTVLG

SEQ ID NO: 1862 - protein, 255 aa, Homo sapiens
EVQLVQSGAEVKKPGASVKVSCEASAELFASSDINWVRRATGQGLEWMGWVNPSSGNAGYAEKFEGRVSMTTNIPKKTVYMELSSLTSEDTAVYYCARGTGYDILTGYYMGSAFDQWGRGTLVTVSSGGGGSGGGGSGGGGSAQSVVTQPPSVSGAPGQRVTISCTGTSSNIGADYDVHWYRQLPGTAPKLLIYGNNNRPSGVPDRFSGSKSGTSASLDISGLQADDEADYYCQSFDRSLRGSVFGGGTKLTVLG

SEQ ID NO: 1863 - protein, 243 aa, Homo sapiens
QVQLVQSGAEVKKPGSSVKVSCKASGGTVSSRTISWVRQAPGQGLEWMGGSLPPSGAPIYAQKFQGRVAITADALTNTAFMELRSLKSDDTAVYYCARDQGRYLDLWGRGTLVTVSSGGGGSGGGGSGGGGSALSSELTQDPTVSVALGQTVRITCRGDILRNYYANWYQQKPGQAPVLVIYGKNSRPSGIPDRFSASNTGKTSSLTITGAQAEDEADYYCNSRDSSGNPQVFGGGTQLTVLS

SEQ ID NO: 1864 - protein, 245 aa, Homo sapiens
QLQLQESGPGLVKPSKTLSLTCGVYGDSSSSSNWWSWVRQPPGKGLEWIGEIHHSGTTNYNPSLNSRVSISLDKSTNQFSLNLNSVTAADTAVYYCAGRDVQGAPYWGRGTLVTVSSGGGGSGGGGSGGGGSAQAVLTQPSSVSGAPGQRVTISCTGTSSNIGADYYVHWYQQLPGTAPKVLIYGNSNRPSGVPDRFSGSKSGTSASLAITGLQAEDEADYYCQTYDSSLSGWVFGGGTKLTVLG

SEQ ID NO: 1865 - protein, 254 aa, Homo sapiens
EVQLVQSGAEVKKPGASVKVSCKASGYTFTSYGISWVRQAPGQGLEWLGWINTNSGDTNYAQKIQGRVTMTTDTSTTTSYMELMSLGSDDTAVYYCARVEGVYDILTGYSFDAFDIWGRGTTVTVSSGGGGSGGGGSGGGGSAQSVVTQPPSASGTPGQRVTISCSGSSSNIGSNTVNWYQQLPGAAPKLLIYANSQRPSGVPDRFSGSKSGTSASLAISGLQSEDEADYYCAVWDDSLNGWVFAGGTKVTVLG

SEQ ID NO: 1866 - protein, 254 aa, Homo sapiens
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCAREQGYDILTGYYPEGGWFDPWGKGTLVTVSSGGGGSGGGGSGGGGSALSSELTQDPAASVALGQTVRITCQGDSLRKYDPSWYQQKPGQAPVLVIYAKNNRPTGISDRFSGSISGNTGSLTITGAQPEDEAEYYCGSRDSSGTHLIFGGGTKLTVLG

SEQ ID NO: 1867 - protein, 250 aa, Homo sapiens
QVQLVQSGAEVKKPGSSVKVSCRASGGSFNHAISWVRQAPGRGLEWMGGILPMYGTANYAQKFQGRVTITADKLTNTVYMDLSRLRYEDTAVYYCARELGLSIVGATTGALDMWGRGTLVTVSSGGGGSGGGGSGGGGSALSSELTQDPAVSVALGQTVRITCQGDSLRSSYASWYQQKPGQAPVMVMFGENNRPSGIPDRFSGSSSGNTASLTITGTQAEDEADYYCNSRGSIGSHVEFGGGTQLTVLS

SEQ ID NO: 1868 - protein, 257 aa, Homo sapiens
EVQLHESGPGLLKPSQTLSLTCAISGDSVSSNSAAWNWITQSPSTGLEWLGRTYYRPKWYNDYAVSAKSRITINPDTSKNQFSLQLNSVTPEDTAVYYCARDKSYYDILTGYYYYYGMDVWGQGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1869 - protein, 251 aa, Homo sapiens
QVQLVQSGAEVKKPGASVKVSCKASGYTFTSYGISWVRQAPGQGLEWMGWISAYNGNTNYAQKLQGRVTMTTDTSTSTAYMELSSLRSEDTAVYYCARMEYDILTGYYGGYFDYWGQGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1870 - protein, 251 aa, Homo sapiens
QVQLVQSGAEVKKPGASVKVSCKASGYTFTSYGISWVRQAPGQGLEWMGWISAYNGNTNYAQKLQGRVTMTTDTSTSTAYMELRSLRSEDTAVYYCARMEYDILTGYYGGYFDYWGRGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1871 - protein, 248 aa, Homo sapiens
QVQLVQSGAEVKKPGASVKVSCKASGYTFTSYGISWVRQAPGQGLEWMGWISAYNGNTNYAQKLQGRVTMTTDTSTSTAYMELRSLRSEDTAVYYCARMEYDILTGYYGGYFDYWGKGTMVTVSSGGGGSGGGGSGGGGSSELTQDPAVSVALGQTVRITCQGDSLGSYYTNWFQQKPGQAPLLVVYAKNKRPSGIPDRFSGSSSGNTASLTITGAQAEDEADYYCNSRDSSGNHVVFGGGTKLTVLG

SEQ ID NO: 1872 - protein, 251 aa, Homo sapiens
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARMEYDILTGYYGGYFDYWGKGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1873 - protein, 247 aa, Homo sapiens
QVQLVQSGAEVKKPGSSVKVSCKASGYTFTSYGISWVRQAPGQGLEWMGWISAYNGNTNYAQKLQGRVTMTTDTSTSTAYMELRSLRSDDTAVYYCAREKYDILTGYYDAFDIWGQGTMVTVSSGGGGSGGGGSGGGGSSELTQDPAVSVALGQTVRITCQGDSLRSYYTNWFQQKPGQAPLLVVYAKNKRPSGIPDRFSGSSSGNTASLTITGAQAEDEADYYCHSRDSSGNHVLFGGGTKLTVLG

SEQ ID NO: 1874 - protein, 252 aa, Homo sapiens
QVNLRESGGEVKKPGASVKVSCKASGYTFSNTGISWVRQAPGQGLEWMGIINPSGGSTSYAQKFQGRVTMTRDTSTSTVYMELSSLRSEDAAVYYCAREMGYDILTGYYLNYMDVWGKGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1875 - protein, 252 aa, Homo sapiens
QVQLVQSGAEVKKPGASVKVSCKAPGYTFTSYGISWVRQAPGQGLEWMGIINPSGGSTSYAQKFQGRVTMTRDTSTSTVYMELSSLRSEDTAVYYCAREMGYDILTGYYLNYMDVWGRGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1876 - protein, 248 aa, Homo sapiens
QVNLRESGGGLVKPGGSLRLSCAASGFTFSGYGMHWVRQAPGKGLEWVASVRNDGSNTYYTDSVKGRFTISRDNSKNTLYLQMNSLRSEDTAVYYCVRMEYDILTGYYGGYFDYWGQGTLVTVSSGGGGSGGGGSGGGGSDIVMTQSPSTLSASVGDRVTITCRASQGISSWLAWYQQKPGRAPKVLIYKASTLESGVPSRFSGSGSGTDFTLTISSLQPEDFATYYCQQSYSTPWTFGQGTKLEIKR

SEQ ID NO: 1877 - protein, 248 aa, Homo sapiens
QVQLVQSGAEVKKPGASVKVSCKASGYTFTSYGISWVRQAPGQGLEWMGWISAYNGNTNYAQKLQGRVTMTTDTSTSTAYMELRSLRSEDTVVYYCARMEYDILTGYYGGYFDYWGKGTMVTVSSGGGGSGGGGSGGGGSSELTQDPAVSVALGQTVRITCQGDSLRSYYTNWFQQKPGQAPLPVVYAKNKRPSGIPDRFSGSSSGNTASLTITGAQAEDEADYYCHSRDSSGNHVLFGGGTKLTVLG

SEQ ID NO: 1878 - protein, 251 aa, Homo sapiens
EVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARMEYDILTGYYGGYFDYWGKGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1879 - protein, 248 aa, Homo sapiens
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARMEYDILTGYYGGYFDYWGRGTMVTVSSGGGGSGGGGSGGGGSDIVMTQSPSTLSASVGDRVTITCRASQGISSWLAWYQQKPGRAPKVLIYKASTLESGVPSRFSGSGSGTDFTLTISSLQPEDFATYYCQQSYSTPWTFGQGTKLEIKR

SEQ ID NO: 1880 - protein, 253 aa, Homo sapiens
QVQLQQSGAEVKKPGSSVKVSCKASGGTFSSYAISWVRQAPGQGLEWMGGIIPIFGTANYAQKFQGRVTITADESTSTAYMELSSLRSEDTAVYYCARESHYDILTGYYSNPSFDIWGRGTMVTVSSGGGGSGGGGSGGGGSQSVLTQPASVSGSPGQSITISCTGTSSDVGGYNYVSWYQQHPGKAPKLMIYKGSKRPSGVSNRFSGSKSGNTASLTISGLQAEDEADYYCSSYTTRSTRVFGGGTKLTVLG

SEQ ID NO: 1881 - protein, 244 aa, Homo sapiens
QVQLVQSGAEVKKPGSSVKVSCKASGGTFSSYAISWVRQAPGQGLEWMGGIIPIFGTANYAQKFQGRVTITADKSTSTAYMELSSLRSDDTAVYYCARDSGSYYYDAFDIWGKGTMVTVSSGGGGSGGGGSGGGGSDIVMTQSPSTLSASVGDRVTITCRASQGISSWLAWYQQKPGKAPKLLIYAASSLQSGVPSRFSGSGSGTDFTLTISSLQPEDFATYYCQQANSFPLTFGGGTKVEIKR

SEQ ID NO: 1882 - protein, 239 aa, Homo sapiens
QVQLVQSGGGLVKPGGSLRLSCAASGFTFSSYSMNWVRQAPGKGLEWVAVVSSDGGNKYYADSVKGRFTISRDNSKNTVYLQMNSLRADDTAVYYCAKTGSGFDYWGRGTLVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKR

SEQ ID NO: 1883 - protein, 243 aa, Homo sapiens
KVQLVESGGGVVQPGRSLRLSCVTSGFTFSSYGMHWVRQAPGKGLEWVAGISYDGAKEYYGDPVKGRFTISRDNTKKTLNLQMNSLRAEDTAVYYCARDGYRTNDALDIWGQGTLATVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKR

SEQ ID NO: 1884 - protein, 242 aa, Homo sapiens
EVQLVESGGGLVQPGGSLRLSCAASGFTFSDYGMHWVRQRPGKGLEWIAFIGSDGSNKYYGDTVKGRFTISRDNAKNSLYLQMNSLRAEGTAVYYCARDWDMDVWGQGTMVTVSSGGGGSGGGGSGGGGSSHVILTQPRSVSGSPGQSVTISCTGTSSDVGGYHYVSWYQQHPGKAPRLMIYEVTKRPSGVSNRFSGSKSGNTASLTISGVQAEDEADYYCSSYTSASTVIFGGGTKLTVLG

SEQ ID NO: 1885 - protein, 247 aa, Homo sapiens
QVQLVQSGAEVKKPGASVRVSCKSSGYTFTNYGISWVRQAPGQGLEWMGWISNNNGKTYYAQKVQGRVTMTTDTSTSTDYMELRGLRSDDTAIYYCARDNGGGTIGFDYWGRGTLVTVSSGGGGSGGGGSGGGGSAQAVLTQPSSVSGAPGQRVTMSCTGSSSNIGAGYDVHWYQQLPGTAPKLLIYDNTNRPSGVPDRFSGSRSGTSASLAITGLQAEDEADYFCQSYDITLSAVFGTGTKVTVLG

SEQ ID NO: 1886 - protein, 240 aa, Homo sapiens
GVQLVESGGGLVKPGGSLRLSCATSGFRFSDYAMTWVRQAPGKGLEWVSSITGSGGGTHYAGSVRGRFTISRDNSKNTVYLQMNNLRPEDTAVYYCASFVLDYWGKGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1887 - protein, 241 aa, Homo sapiens
EVQLVQSRGGVVQPGRSLRLSCAASGLTFSSYGMHWVRQAPGKGLEWVAVISYDGRNKYYADSVKGRFTTSRDNSKNTLYLQMNSLRAEDTAVYYCAKWTSSGAFDIWGRGTLVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCHQYSNYPLTFGGGTKLEIKR

SEQ ID NO: 1888 - protein, 241 aa, Homo sapiens
EVQLVESGGGLVQPGGSLRLSCAASGFTFSDYGMHWVRQRPGKGLEWIAFIGSDGSNKYYGDTVKGRFTISRDNAKNSLYLQMNSLRAEGTAVYYCARDWDMDVWGQGTMVTVSSGGGGSGGGGSGGGGSHVILTQPRSVSGSPGQSVTISCTGTSSDVGGYHYVSWYQQHPGKAPRLMIYEVTKRPSGVSNRFSGSKSGNTASLTISGVQAEDEADYYCSSYTSASTVIFGGGTKLTVLG

SEQ ID NO: 1889 - protein, 241 aa, Homo sapiens
QVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCARDNLHAAFDIWGRGTLVTVSGGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKR

SEQ ID NO: 1890 - protein, 248 aa, Homo sapiens
QMQLVQSGGGVVQPGRSLRLSCAASGFTFSSYGMHWVRQAPGKGLEWVAVISYDGSIKYYADSVKGRFTISRDNSKNTLYLQMNSLRAEDTAVYYCARYYYHSSGSDAFDIWGQGTLVTVPSGGGGSGGGGSGGGGSQSVLTQPPSASGTPGQRVTISCSGSSSNIGSNTVNWYQRLPGAAPQLLIYNNNQRPSGVPDRFSGSKSGTSASLAISGLQSEDEADYYCAAWDDSLNGWVFGGGTKLTVLG

SEQ ID NO: 1891 - protein, 249 aa, Homo sapiens
QVQLQQSGAELKQPGTSVKVSCKASGYSFSCYDVNWVRQAPGQGLEWMGRINPNSGNTHYAQKFQDRVTMTTDTSTSTAYMELNSLRPDDTAVYFCARVGIKAAAVDNFEYWGRGTTVTVSSGGGGSGGGGSGGGGSAQSVLTQPPSASGTPGQRVTITCSGSSSNIGDYYVNWYQQVSGTTPKLIIYRDDQRPSGVPDRFSGSKSGASASLAISGLRSEDEANYFCAAWDDSLREFAFGTGTKVTVLG

SEQ ID NO: 1892 - protein, 247 aa, Homo sapiens
QVTLKESGGDLVQPGGSLRLSCAASGLTFMSYAMTWVRQAPGKGLEWVSSISGSGDNTYYGDSVRGRFTISRDNSKNTLFLQLNSLRAEDTAFYYCAKVHSTGYAFENWGRGTLVTVSSGGGGSGGGGSGGGGSAQSVLTQPPSVSGAPGQRVTISCTGSSSNIGAGYNVHWYQQLPGTAPRLLISSNTNRPSGVPDRFSGSKSGTSASLAITGLQAEDEADYYCQSYDSSLSGFVFGTGTKVTVLG

SEQ ID NO: 1893 - protein, 254 aa, Homo sapiens
QVQLVQSGAEVKKPGASVKVSCKASGYTFTNYYMHWVRQAPGQGLEWMGIINPRDVSTTYAQKFQGRATMTRDTSTSTVYMELNSLRSEDTAVYYCAREYSGYHYVEGGSYAMDVWGQGTMVTVSSGGGGSGGGGSGGGGSALSYVLTQPPSASGTPGQRVTITCSGSSSNIGNYYVNWYQQVSGTAPKLIIYRNNQRPSGVPDRFSGSKSGASASLAISGLRSEDEADYFCAAWDDSLREFVFGTGTKVTVLG

SEQ ID NO: 1894 - protein, 249 aa, Homo sapiens
QVQLVQSGAELKQPGTSVKVSCKASGYSFSSYGVTWVRQAPGQGLEWMGWVSGNRGNTQYAQKFQDRVRMTTDTSTSTAYMELRSLRPDDTAVYFCARVGIKAAAVDNFEYWGRGTTVTVSSGGGGSGGGGSGGGGSAQSVLTQPPSASGTPGQRVTITCSGSSSNIGDYYVNWYQQVSGTTPKLIIYRDDQRPSGVPDRFSGSKSGASASLAISGLRSEDEANYFCAAWDDSLREFAFGTGTKVTVLG

SEQ ID NO: 1895 - protein, 253 aa, Homo sapiens
EVQLVQSGAAVKKPGASVKVSCKASGYTFTTYYIHWVRQAPGQGLEWMGIINPVNGNTIYAQKFQGRVTMTRDTSTGTVNMELSSLRSEDTAVFYCVREGGGDAYDVAPYYFDYWGQGTLVTVSSGGGGSGGGGSGGGGSAQAVLTQPSSVSGAPGQRVTISCTGSSSNIGDGYDVHWYQQLPGTAPKLLIYGNSHRPSGVPDRFSGSKSDTSASLAITGLQVEDEADYFCHSYDSSVSGWIFGGGTKLTVLG

SEQ ID NO: 1896 - protein, 245 aa, Homo sapiens
QVQLVQSGAEVKKPGASVKVSCKASGYTFTSYAMHWVRQAPGQRLEWMGWINAGNGNTKYSQKFQGRVTITRDTSASTAYMELSSLRSEDTAVYYCAREGPGYYYGMDVWGQGTMVTVSSGGGGSGGGGSGGGGSALETTLTQSPGTLSLSPGERATLSCRASQAIGSNYLAWYQQKPGQPPSLLIYGASSRATGIPDRFSASGSGTDFTLTISRLEPEDFAVYYCQQYGSSITFGQGTRLEIKR

SEQ ID NO: 1897 - protein, 249 aa, Homo sapiens
QVQLVQSGAEVKKPGASVRVSCKSSGYTFTNYGISWVRQAPGQGLEWMGWISNNNGKTYYAQKVQGRVTMTTDTSTSTDYMELRGLRSDDTAIYYCARDNGGGTIGFDYWGQGTLVTVSSGGGGSGGGGSGGGGSAQSVLTQPPSVSGAPGQRVTISCTGSSSNIGADYDVHWYQLLPGTAPKLLIYGNTNRPSGVPDRFSGSKSGTSASLTIAGLQAEDEADYYCQSYDSSLSGSVVFGGGTKLTVLG

SEQ ID NO: 1898 - protein, 240 aa, Homo sapiens
QVQLQQSGGGVVQPGRSLRLSCAASGFTYSSYAMHWVRQAPGKGLEWVAVISYDGSIKYYADSVKGRFTISRDNSKNTLYLQMNSLRAEDTAVYYCARDLDFDYWGKGTLVTVSSGGGGSGGGGSGGGGSQSVLTQPPSVSAAPGQKVTISCSGSTSNIGNNYVSWYQQHPGKAPKFMIYDVSKRPSGVSNRFSGSKSGNTASLTISGVQAEDEADYYCSSYTSASTVIFGGGTKLTVLG

SEQ ID NO: 1899 - protein, 247 aa, Homo sapiens
QVQLVQSGAEVKKPGGSVKVSCKASAYTFTRYYMHWVRQAPGQGLEWMGIINPSGGRTSYAQKFQGRVTMTRDTSTSTVYMELSSLRSEDTAVYYCARDLGIAGTIYFDYWGKGTLVTVSSGGGGSGGGGSGGGGSQSVLTQPPSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLG

SEQ ID NO: 1900 - protein, 245 aa, Homo sapiens
QVQLVQSGSEVKKPGASVKVSCKTSGYSFTGYFIHWVRQAPGQGLEWMGWINPNSGGTNLAQKFQGRVTMTRDTSISTAYMELSSLKSDDTAVYYCARDASRDIVVLPLAIWGKGTLVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKR

SEQ ID NO: 1901 - protein, 241 aa, Homo sapiens
EVQLVQSRGGVVQPGRSLRLSCAASGLTFSSYGMHWVRQAPGKGLEWVAVISYDGRNKYYADSVKGRFTTSRDNSKNTLYLQMNSLRAEDTAVYYCAKWTSSGAFDIWGRGTLVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKR

SEQ ID NO: 1902 - protein, 245 aa, Homo sapiens
QMQLVQSGAEVKKPGASVKVSCKASGYTFTSYYMHWVRQAPGQGLEWMGLVHPNDGSVNYAQKFKGRVTMTRDTSTSTVYMELSSLRSDDTAVYYCARDRGSGWPNWYFDLWGQGTLVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKH

SEQ ID NO: 1903 - protein, 247 aa, Homo sapiens
QVQLVQSGAEVKKPGASVKVSCKASEYTFYNHYMHWVRQAPGQGLEWMGFINPSGDAAWYAQKFQGRVTLTRDTSTRTVYMELSGLTSEDTAVYYCARESGAGGYYYDDYWGKGTLVTVSSGGGGSGGGGSGGGGSALSYVLTQPPSVSVAPGKTASIPCGGNNIGSKSVQWYLQKAGQAPILVVYDDSDRPSGIPERFSGSNSGNTATLTITRVEAGDEADYYCQVWDSSSDHWFFGGGTKLTVLG

SEQ ID NO: 1904 - protein, 249 aa, Homo sapiens
QVQLVQSGAELKQPGTSVKVSCKASGYSFSSYGVTWVRQAPGQGLEWMGWVSGNRGNTQYAQKFQDRVRMTTDTSTSTAYMELRSLRPDDTDVYFCARVGIKAAAVDNFEYWGRGTTVTVSSGGGGSGGGGSGGGGSAQSVLTQPPSASGTPGQRVTITCSGSSSNIGDYYVNWYQQVSGTTPKLIIYRDDQRPSGVPDRFSGSKSGASASLAISGLRSEDEANYFCAAWDDSLREFAFGTGTKVTVLG

SEQ ID NO: 1905 - protein, 240 aa, Homo sapiens
QVQLVQSGGGLVQPGGSLRLSCAASGFTFSSYEMNWVRQAPGKGLEWVSYISSSGSTTYYADSVKGRFTISRDNAKNSLYLQMNSLRAEDTAVYYCARDTTDYWGQGTMVTVSSGGGGSGGGGSGGGGSQSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLG

SEQ ID NO: 1906 - protein, 237 aa, Homo sapiens
QVQLVQSGGGLVQPGGSLRLSCAASGFTFSSYEMNWVRQAPGKGLEWVSYISSSGSTTYYADSVKGRFTISRDNAKNSLYLQMNSLRAEDTAVYYCARDTTDYWGQGTLVTVSSGGGGSGGGGSGGGGSDIVMTQSPSTLSASVGDRVTITCRASQGISSWLAWYQQKPGRAPKVLIYKASTLESGVPSRFSGSGSGTDFTLTISSLQPEDFATYYCQQSYSTPWTFGQGTKLEIKR

SEQ ID NO: 1907 - protein, 238 aa, Homo sapiens
VQLVQSGAEVKKPGASVKVSCKASGYTFTSYGISWVRQAPGQGLEWMGWINPNSGGTNYAQKFQGRVTMTRDTSISTAYMELSRLRSDDTAVYYCARNLWGLDYWGKGTMVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1908 - protein, 244 aa, Homo sapiens
GVQLEESGAEVKKPGASVKVSCKASGYTFTGYYMHWVRQAPGQGLEWMGWINPNSGGTNYAQKFQGRVTMTRDTSISTAYMELSRLRSDDTAVYYCARGNAWGAFDIWGRSTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTVSGLQAEDEADYYCSSYTTRSTRVFGGGTKLTVLG

SEQ ID NO: 1909 - protein, 243 aa, Homo sapiens
QVQLQQSGGGLVQPGGSLRLSCEASGFTFSHYWMTWVRQAPGKGLEAVASIKRDGSQQYYLDSVKGRFTISRDNAKNSLSLQMSSLRAEDTAVYYCAREGVAAGEDYWGRGTLVTVSSGGGGSGGGGSGGGGSQSVLTQPPSVSAAPGQKVTISCSGSNSNIGNNYVSWYQQHPGKVPKLMIYEGSKRPSGVSNRFSASKSGNTASLTISGLQAEDEADYYCSSYTSSSTYAFGTGTKLTVLG

SEQ ID NO: 1910 - protein, 244 aa, Homo sapiens
EVQLVESGGGVVQPGRSLRLSCAASGFDFMYYAMHWVRQAPGKGLEWVAVIWYDGSNKYYADSVKGRFTISRDNSKNTLYLQMNSLRAEDTAVYYCAKGGMDWDFDYWGRGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1911 - protein, 241 aa, Homo sapiens
QVQLQESGGGLVKPGGSLRLSCAASGFTFSDYYMSWIRQAPGKGLEWVSYISSSSSYTNYADSVKGRFTISRDNAKNSLYLQMNSLRAEDTAVYYCARVDSSGYAYYWGKGTMVTVSSGGGGSGGGGSGGGGSSELAQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1912 - protein, 240 aa, Homo sapiens
QVQLVQSGGGVVQPGRSLRLSCAASGFTFSSYGMHWVRQAPGKGLEWVAVISYDGSIKYYADSVKGRFTISRDNSKNTLYLQMNSLRAEDTAVYYCARDAAVTAEGWGKGTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1913 - protein, 246 aa, Homo sapiens
QVQLLQSAAEVKKPGASVKVSCKASGYTITNYFMHWVRQAPGQGLEWMGIINPSGDTTWSAPKFQGRVTMTRDTSTSTVYMEVSSLRTEDTAVYYCARGSNYSPDAFDIWGQGTLVTVSSGGGGSGGGGSGGGGSQSVLTQPPSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLG

SEQ ID NO: 1914 - protein, 255 aa, Homo sapiens
EVQLVESGGGLVKPGGSLRLSCAASGFTFSNAWMYWVRQAPGKGLEWVGRIRSKSDGGTTDYAAPVEGRFTISRDDSKYTLYLQMNSLKSEDTAVYYCMSLPPDLRYCDGGICPGFDWLGPWGQGTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCHSRDSSGNHVLFGGGTKLTVLG

SEQ ID NO: 1915 - protein, 242 aa, Homo sapiens
QVQLLQSAAEVKKPGSSVKVSCKASGGTFSSYAISWVRQAPGQGLEWMGGIIPIFGTANYAQKFQGRVTITADKSTSTAYMELSSLRSEDTAVYYCARGPSYYYYMAVWGQGTLVTVSSGGGGSGGGGSGGGGSDIQMTQSPSFLSASVGDRVTITCRASQGINNYLAWYQQKPGRAPKLLIYAASSLQSGVPSRFSGSGSGTDFTLTISSLQPEDFATYYCLQDSDYPLTFGGGTKLEIKR

SEQ ID NO: 1916 - protein, 243 aa, Homo sapiens
QVQLQQSGGGLVQPGGSLRLSWEASGFTFSHYWMTWVRQAPGKGLEAVASIKRDGSQQYYLDSVKGRFTISRDNAKNSLSLQMSSLRAEDTAVYYCAREGVAAGEDYWGRGTLVTVSSGGGGSGGGGSGGGGSQSVLTQPPSVSAAPGQKVTISCSGSNSNIGNNYVSWYQQHPGKVPKLMIYEGSKRPSGVSNRFSASKSGNTASLTISGLQAEDEADYYCSSYTSSSTYAFGTGTKLTVLG

SEQ ID NO: 1917 - protein, 246 aa, Homo sapiens
QVQLMQSAAEENKPGPSVKVSCKASGYTITNYFMHWVRQAPGQGLEWMGIINPSGDTTWSAPKFQGRVTMTRDTSTSTVYMEVSSLRTEDTAVYYCARGSNYSPDAFDIWGQGTLVTVSSGGGGSGGGGSGGGGSQSVLTQPPSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLG

SEQ ID NO: 1918 - protein, 240 aa, Homo sapiens
EVQLVESGGGLVQPGGSLRLSCAASGFTFSDYAMSWVRQAPGKGLEWVSAISGSGGSTSYADSVKGRFTISRDNSKNTLYLQMNSLRAEDTAVYYCASLLSDYWGRGTTVTVSSGGGGSGGGGSGGGGSQSVLTQPASVSGSPGQSITISCTGTSSDVGGYNYVSWYQQHPGKAPKLMIYEGSKRPSGVSYRFSGSKSGNTASLTISGLQAEDEADYYCSSYTTRSTRVFGGGTKLTVLG

SEQ ID NO: 1919 - protein, 245 aa, Homo sapiens
EVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDLSGSYFSRYFDYWGQGTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1920 - protein, 246 aa, Homo sapiens
QVQLVQSGAEVKKPGSSIKVSCKASGGTFSHSAISWVRQAPGQGLEWMGGIIPLFGSANYAERFQGRVTITADEVASTAYMELTSLTSEDTAMYFCARVEWEDIVVGSAFDIWGKGTTVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKR

SEQ ID NO: 1921 - protein, 251 aa, Homo sapiens
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARVTSLYSSSSGGYYYYGMDVWGRGTTVTVSSGGGGSGGGGSGGGGSDIQMTQSPSFLSASVGDRVTITCRASQGINNYLAWYQQKPGRAPKLLIYAASSLQSGVPSRFSGSGSGTDFTLTISSLQPEDFATYYCLQDSDYPLTFGGGTKLEIKR

SEQ ID NO: 1922 - protein, 239 aa, Homo sapiens
EVQLVETGGGLVQPGGSLRLSCAASGFTFSSYAMSWVRQAPGKGLEWVSAISGSGGSTYYADSVKGRFTISRDNSKNTLYLQMNSLRAEDTAVYYCAKGWRGVDYWGRGTLVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKR

SEQ ID NO: 1923 - protein, 247 aa, Homo sapiens
EVQLVQSGGGLVQPGGSLRLSCAASGFTFSSYAMSWVRQAPGKGLEWVSAISGSGGSTYYADSVKGRFTISRDNSKNTLYLQMNSLRAEDTAVYYCAKAGGNPRSGSLVYFDYWGRRTMVTVSSGGGGSGGGGSGGGGSDIQMTQSPSTLSASIGDRVTITCRASEGIYHRLAWYQQKPGKAPKLLVYKASSLASGAPSRFSGSGSGTDFTLTISSLQPDDFATYYCQQYSNYPLTFGGGTKLKIKR

SEQ ID NO: 1924 - protein, 244 aa, Homo sapiens
EVQLVESGGGVVQPGGSLRLSCAASGFTFSSYAMSWVRQAPGKGQELVSAISGSGGSAYYADSVKGRFTISRDNSKNTLYLQMNSLRAEDTAVYYCAKGLDVYAIYGLDVWGQGTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCHSRDSSGNHVLFGQGTKLEIKR

SEQ ID NO: 1925 - protein, 254 aa, Homo sapiens
QVQLQESGGGVVQPGRSLRLSCEASGFTFSSYGMHWVRQAPGKGLEWVAVISYDERIKNYGDSVKGRFTGSRDNSKNTLYLEMNSLRPEDTAVYYCATEVRNYDLLTRSYLAGPLDNWGKGTLVTVSSGGGGSGGGGSGGGGSQSVLTQPASVSGSPGQSITISCTGTSSDVGGYNYVSWYQQHPGKAPKLMIYEGSKRPSGVSSRFSGSKSGNTASLTISGLQAEDEADYYCSSYTTRSTRVFGGGTKLTVLG

SEQ ID NO: 1926 - protein, 245 aa, Homo sapiens
QVQLVQSGGGLVQPGRSLRLSCAASGFTFDDYAMHWVRQAPGKGLEWVSGISWNSGSIGYADSVRGRFTISRDNAKNSLYLQMNSLRAEDTATYYCAREIGWEGAFDIWGRGTLVTVSSGGGGSGGGGSGGGGSQSVLTQPPSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLG

SEQ ID NO: 1927 - protein, 243 aa, Homo sapiens
QVQLVQSGAEVKKPGSSVKVPCKASGGSFRKYGFSWVRQAPGQGLEWMGGIVPIYRATNYAQKFRDRLTITADDATNTVYMDLRSLGSDDTAVYYCATVRPGLMDVWGQGTTVTVSSGGGGSGGGGSGGGGSQSVLTQPPPVFAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLG

SEQ ID NO: 1928 - protein, 247 aa, Homo sapiens
QVTLKESGGGVVQPGRSLRLSCAASKFTFRNYGMHWVRQAPGKGLEWVAGIWFDGSKTFYSDSVKGRFTISRDNSKNTMYLQMNSLRAEDTAVYFCAKEAYTSSWAEFDFWGKGTMVTVSSGGGGSGGGGSGGGGSQSVLTQPPSVSAAPGQKVTISCSGSTSNIGNNYVSWYQQHPGKAPKLMIYDVSKRPSGVPDRFSGSKSGNSASLDISGLRSEDEADYYCAAWDDSLSEFLFGTGTKLTVLG

SEQ ID NO: 1929 - protein, 243 aa, Homo sapiens
RVQLVQSGGGLVQPGESLRLSCSASGFTFSSYAMSWVRQAPGKGLEWVSGISGSGSSTYYADSVKGRFTISRDNSKNMLYLQMNSLRAEDTAIYYCAKNITPLAMVGDFWGRGTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1930 - protein, 240 aa, Homo sapiens
QVQLVQSGGGLVQPGGSLRLSCAASGFTFNSYAMSWVRQAPGKGLEWVSSISGSGGSTYYADSVKGRFTISRDNSKNTLYLQMNSLRVEDTAVYYCASLIEDFWGRGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 1931 - protein, 238 aa, Homo sapiens
QVQLAQSGGGVVQPGRSLRLSCAASGFTFSSYGMHWVRQAPGKGLEWVAVISYDGSNKYYADSVKGRFTISRDNSKNTLYLQMNSLRAEDTAVYYCASDSGSPDWGKGTLVTVSSGGGGSGGGGSGGGGSSELTQDPAVSVALGQTVRITCQGDSLRSYYAGWYQQKPGQAPVLVIYGKNNRPSGIPDRFSGSSSGNTASLTITGAQAEDEADYYCNSRDSSGNHVVFGGGTKLTVLG

SEQ ID NO: 1932 - protein, 241 aa, Homo sapiens
QVQLVQSGGGLVQPGGSLRLSCEASGFTFSHYWMTWVRQAPGKGLEAVASIKRDGSQQYYLDSVKGRFTISRDNAKNSLSLQMSSLRAEDTAVYYCAREGVAAGEDYWGQGTLVTVSSGGGGSGGGGSGGGGSDVVMTQSPSSVSASVGDRVTITCRASQGISSYLAWYQQKPGKAPKLLIYAASTLQSGVPSRFSGGGSGTDFTLTISTLQPEDVATYYCENYNSVPLSFGGGTKLEIKR

SEQ ID NO: 1933 - protein, 244 aa, Homo sapiens
GVQLVQSGGGVVQPGRSLRLSCAASGFTFSSYAIHWVRQAPGKGLEWVAVVSYDGSKKYYGDSVKGRFTISRDNAKDSLYLQMNNLRVEDTAVYYCAREKRGSRRVFDIWGQGTMVTVSSGGGGSGGGGSGGGGSQSVLTQDPAVSVALGQTVRITCQGDSLRSYYTNWFQQKPGQAPLLVVYAKNKRPSGIPDRFSGSSSGNTASLTITGAQAEDEADYYCNSRDSSGNHVVFGGGTKLTVLG

SEQ ID NO: 1934 - protein, 247 aa, Homo sapiens
QVTLKESGGGVVQPGRSLRLSCAASKFTFRNYGMHWVRQAPGKGLEWVAGIWFDGSKTFYSDSVKGRFTISRDNSKNTMYLQMNSLRAEDTAVYFCAKEAYASSWAEFDFWGRGTPVTVSSGGGGSGGGGSGGGGSQSVLTQPPSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLG

SEQ ID NO: 1935 - protein, 243 aa, Homo sapiens
QVTLKESGGGLIQPGGPLRLSCAASGFTFSSYGMHWVRQAPGKGLEWVAFIWYDGSNKYYADSVKGRFTISRDNSKNTLYLQMNSLRAEDTAVYYCAKPYGSGSYAFDIWGKGTLVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKR

SEQ ID NO: 1936 - protein, 253 aa, Homo sapiens
QVNLRESGAEVKKPGASVKVSCKASGYTFTSYYMHWVRQAPGQGLEWMGWINPNSGGTNYAQKFQGRVTITRDTSASTAYMELSSLRSEDTAVYYCARARDYYDSSGYYVPDAFDIWGKSTLVTVSSGGGGSGGGGSGGGGSQSVLTQPPSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLG

SEQ ID NO: 1937 - protein, 241 aa, Homo sapiens
AVQLVQSGGGLVKSGGSLRLSCAASGFTFSSYSMNWVRQAPGKGLEWVSSISSSSSYIYYADSVKGRFTISRDNAKNSLYLQMNSLRAEDTAVYYCARGHFYGMDVWGRGTMVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSSTHRGVFGGGTKLTVLG

SEQ ID NO: 1938 - protein, 253 aa, Homo sapiens
EVQLVQSGGGLVKPGGSLRVSCAASGFTFSNAWMYWVRQAPGKGLEWVGRIRSKGDGGTADYAAPVEGRFTISRDDSKYTLYLQMNSLKSEDTAVYYCMSLPPDLRYCDGGMCSGFDWLGPWGQGTLVTVSSGGGGSGGGGSGGGGSSELTQDPAVSVALGQTVRITCQGDSLRSYYASWHQQKPGQAPVLVIYGKNNRPSGIPDRFSGSSSGNTASLTITGAQAEDEADYYCQAWDSSHVVFGGGTKLTVLG

SEQ ID NO: 1939 - protein, 247 aa, Homo sapiens
QVQLMQSGGGVVQPGRSLRLSCAASGFTFSSYGMHWVRQAPGKGLEWVAVISYDGSIKYYADSVKGRFTISRDNAKNSLFLQMNSLRTEDTAVYYCARESLLTEEYCGSDCYSWGRGTLVTVSSGGGGSGGGGSGGGGSSELTQDPAVSVALGQTVRITCQGDSLRSYYASWYQQKPGQAPVLVIYGKNNRTSGIPDRFSGSSSGNTASLTITGAQAEDEADYYCNSRDSSGNHVVFGGGTKLSVLG

SEQ ID NO: 1940 - protein, 243 aa, Homo sapiens
QMQLVQSGGGVVQPGRSLRLSCAASGFTFSSYGMHWVRQAPGKGLEWVSAINHSGGSTYYADSVKGRFTISRDNTKNTLSLQMNSLKAEDTAVYYCVPNSAPPAPSMDVWGRGTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1941 - protein, 237 aa, Homo sapiens
QVQLVESGGGLVHPGGSLRLSCAASGFTFSNFALSWVRQAPGRGLEWVSSISPSGGRTYYADSVEGRFTISRDNAKNLVYLQMNSLRVDDTAVYFCASRYYDYWGRGTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1942 - protein, 243 aa, Homo sapiens
QVQLVQSGEGLVQPGESLRLSCSASGFTFSSYAMSWVRQAPGKGLEWVSGISGSGSSTYYADSVKGRFTISRDNSKNMLYLQMNSLRAEDTAIYYCAKNITPLAMVGDFWGQGTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 1943 - protein, 243 aa, Homo sapiens
EVQLVQSGAEVKKAGESLKISCKGSGYTFTSYGITWVRQAPGQGLEWMGWISGYNANTTYAQNLQGRVTMTRDTSTSTVYMELRSLRSDDTAVYYCARADYSNDYYMDVWGKGTMVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSDYPLTFGGGTKLEIKR

SEQ ID NO: 1944 - protein, 243 aa, Homo sapiens
RVQLVQSGGGLVQPGESLRLSCSASGFTFSSYAMSWVRQAPGKGLEWVSGISGSGSSTYYADSVKGRFTISRDNSKNMLYLQMNSLRAEDTAIYYCAKNITPLAMVGDFWGQGTLVTVSSGGGGSGGGGSGGGGSSELTQDPAVSVALGQTVRITCQGDSLRSYYASWYQQKPGQAPVLVIYGKNIRPSGIPDRFSGSSSGNTASLTITGAQAEDEADYYCNSRDSSGNHVVFGGGTKLTVLG

SEQ ID NO: 1945 - protein, 243 aa, Homo sapiens
QVQLQQSGGGLVQPGGSLRLSCSASGFTFSSYAMHWVRQAPGKGLEYVSAISSNGGSTYYADSVKGRFTISRDNSKNTLYLQMSSLRAEDTAVYYCARFPLESYYYMDVWGQGTTVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKR

SEQ ID NO: 1946 - protein, 245 aa, Homo sapiens
EVQLVESGAEVKKPGASVRVSCEASGYTFTGYYMHWVRQAPGQGLEWMGWINPDSGKTKYAQKFQGRVTMTRDTSISTAYMELSRLRSDDTAVYYCARGNSFGRTLDYWGRSTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLRAEDEADYYCSSYTTRSTRVFGGGTKLTVLG

SEQ ID NO: 1947 - protein, 243 aa, Homo sapiens
EVQLVQSGAEVKKPGASVKVSCKASGYTFTSYYMHWVRQAPGQGLEWMGIINPSGGSTSYAQKFQGRVTMTRDTSTSTVYMELSSLRSDDTAVYYCARDVPPPDGYLEVWGRGTMVTVSNGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSPDSSGNHVVFGGGTKLTVLG

SEQ ID NO: 1948 - protein, 241 aa, Homo sapiens
QVQLVQSGAEVKKPGSSVKVSCRASGYSFTGYYIHWVRRAPGQGLEWLGWINPNSGNTGYAQKFQGRVTMTRNTSISTAYMELSSLRSEDTAVYYCARASYPVPFDYWGKGTLVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLETER

SEQ ID NO: 1949 - protein, 242 aa, Homo sapiens
QLQLQESGGGLVQPGGSLRLSCVASGFTFTTYPMSWVRQAPGKGLEWVSVMSGSGGSTYYADSVKGRFTISRDNSKNTLYLQMNSLRAEDTAVYYCAKGGWLDDWGQGTMVTVSSGGGGSGGGGSGGGGSAQSVLTQPPSVSAAPGQEVTMSCSGSSSNVGHNYVSWYQQLPGTAPKLLIYDDDKRPSGIPDRFSGSKSGTSATLAIRGLQTGDEADYYCATWDVRLRDVLFGGGTKLTVLG

SEQ ID NO: 1950 - protein, 245 aa, Homo sapiens
QVQLQQSGAEVKKPGASVKISCKASGYTFASYYMHWVRQAPGQGLEWVGIINPSGGKTTYAQNFQGRVTMTRDTSTSTVSMELNSLKSDDTAVYYCAREHSSSFDYWGQGTMVTVSSGGGGSGGGGSGGGGSAQSVLTQPPSVSGAPGQRVTISCTGSSSNIGDGYDVHWYQQLPGTAPKLLIYGNGHRPSGVPDRFSGSKSDTSASLAITGLQVEDEADYFCHSYDSSVSGWIFGGGTKVTVLG

SEQ ID NO: 1951 - protein, 253 aa, Homo sapiens
EVQLVQSGAAVKKPGASVKVSCKASGYTFTTYYIHWVRQAPGQGLEWMGIINPINGNTIYAQKFQGRVTMTRDTSTGTVNMELSSLRSEDTAVFYCAREGEGDGYNVAPYYFDYWGRGTLVTVSSGGGGSGGGGSGGGGSAQAVLTQPSSVSGAPGQRVTISCTGSSSNIGAGYDVHWYQQLPGTAPKLLIYGNSNRPSGVPDRFSGSKSDTSASLAITGLQVEDEADYFCHSYDSSLSGWIFGGGTKLTVLG

SEQ ID NO: 1952 - protein, 250 aa, Homo sapiens
EVQLVQSGVEVKKPGASVKVSCKASGYTFRDYYMHWVRQAPGQGPEWMGIINPTGGTTSYAPKFQGRVTMTRDTSTNTLYMELRRLKFDDTAVYYCAREAGGSGSYHFSFPFDYWGQGTLVTVSSGGGGSGGGGSGGGGSALETTLTQSPATLSVSPGERATLSCRASQSVSSNLAWYQQKPGQAPRLLIYGASTRATGIPARFSGSGSGTEFTLTISSLQSEDFAVYYCQQYNNWPRTFGQGTRLEIKR

SEQ ID NO: 1953 - protein, 247 aa, Homo sapiens
EVQLVESGGGLVQPGWSLRLSCAASGFTFSYSAMTWVRQAPGKGLEWVSAITSSGGATYYADSVKGRFTISRDNSKNTLYLQMNSLRAEDTAIYYCAKTGIWGYYFDYWGQGTLVTVSSGGGGSGGGGSGGGGSAQSVLTQPPSVSGAPGQRVTISCTGRSSNIGAGFDVHWYLQLPGRAPKVLIYGNSNRPSGVPDRFSGSKSGTSASLAITGLQAEDEADYYCQSYDRSLRAFVFGTGTKVTVLG

SEQ ID NO: 1954 - protein, 252 aa, Homo sapiens
QVQLVQSGAEVKKPGASVKVSCKASGYTFTNYFIHWVRQAPGQGLEWMGIINPNGGITKYKESFQGRVTMTRDTSTNTLYMEMRSLRSEDTAVYYCARDGNLNYDGSTDYGMDVWGRGTTVTVSSGGGGSGGGGSGGGGSAQAVLTQPSSASGTLGQRLSISCSGSSSNIGSNSVSWYHQVAGTAPKLLIYGSDERPSGVPYRFSGSKSGTSASLAISELRSEDEGDYYCATWDDSLRGWVFGGGTKLTVLG

SEQ ID NO: 1955 - protein, 248 aa, Homo sapiens
EVQLVQSGAEVKKPGSSVKVSCKSSGGTFSSYALSWVRQAPGQGLEWMGGIIPIFGTTNYAQKFQGRVTITADKSTSTAYMELSSLRSEDTAVYYCTTLGRNYTSSWSLDYWGRGTMVTVSSGGGGSGGGGSGGGGSALSSELTQDPAVSVALGQTVRITCQGDSLRSYYASWYQQKPRQAPVLVIYGKNDRPSGIPDRFSGSNSGNTASLTITGAQAEDEADYYCNSRDTSGNHLVFGTGTKLTVLG

SEQ ID NO: 1956 - protein, 249 aa, Homo sapiens
EVQLVQSGGGVVQPGRSLRLSCAASGFTFTSYGMHWVRQAPAKGLEWVAFISYDGSHKYYADSVKGRFTISRDNSKNTLYLQMNSLRAEDTAVYYCAKVVGGYSSTLGTDVWGRGTLVTVSSGGGGSGGGGSGGGGSAQAVLTQPSSASGTPGQRVTISCSGRNSNVGSNYVYWYQQFPGTAPKLLIHRSNQRPSGVPDRFSGSKSGTSASLAISGLRSEDEAAYYCATWDDSLSVWVFGGGTKLTVLG

SEQ ID NO: 1957 - protein, 249 aa, Homo sapiens
EVQLVQSGAEVKKPGESLKISCKGYGYNFKGHWIVWVRQVPGKGLDYMGIIYPDDSSTTYRPSFQGQVTISVDKSTSTAYLQWSSLKASDTAMYYCARLGVARGREAFDLWGQGTLVTVSSGGGGSGGGGSGGGGSALSYELTQPPSTSATPGQTVTISCYGSSDNIGHERVAWYQHVPGTAPKLVIYNDDRRPAGVPDRFSGSKSDSSASLAISGLQSEDEGDYYCASWDVRMFGFVFGTGTKVTVLG

SEQ ID NO: 1958 - protein, 254 aa, Homo sapiens
QVQLQQSGPGLAKPSQTLSGTCAISGDSVSSNSATWNWIRQSPSRGLEWLARTYYRSTWHNDYAVSVNSRIRVDPDTSKNQFSLLLNSVTPEDTAVYFCARAVRSPGYYYYYMDVWGQGTTVTVSSGGGGSGGGGSGGGGSAQAVLTQPSSASGTPGQRVTITCSGSSSNIGSNTVNWYQQLPGTAPKLLIFGNNQRPSGVPDRFSGSKSGTSASLAISGLQSEDEADYFCAAWDDSLNVPWVFGTGTKLTVLG

SEQ ID NO: 1959 - protein, 243 aa, Homo sapiens
QVQLVQSGAEVKKPGASVKVSCKASGYTFTNYPVHWLRQAPGQRPEWVGQFNPATGNTQYSENFQGRVAITSDTAATTSYMELNSLTSEDTAVYYCARGRKPLFDYWGRGTLVTVSSGGGGSGGGGSGGGGSALSSELTQDPAVSVALGQTVRITCQGDSLTTYYARWYQQKPGQAPLLVIYGRNNRPSGIPDRFSGSRSGSTASLTITGAQAEDEADYYCNSRDSRGNHYVFGTGTKLTVLG

SEQ ID NO: 1960 - protein, 248 aa, Homo sapiens
QVQLQESGPGLVKPSQTLSLTCTVSGASINTGGYDWTWIRQHPGKGLELIGHIHYSGSTYKKASLKSRLNMSLDRSKNQFSLNLSSVTAADTAIYYCARKQRREKYFDYWGRGTLVTVSSGGGGSGGGGSGGGGSAQSVLTQPPSVSGAPGQKVTISCTGSRSNFGADYDVHWYQQRPGAAPKLLISNNKNRPSGVPDRFSGSRSGTSASLTITGVQSDDEADYYCQSYDSSLSGFVFGGGTKLTVLG

SEQ ID NO: 1961 - protein, 254 aa, Homo sapiens
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREKAIIETTSGEADPFDIWGRGTLVTVSSGGGGSGGGGSGGGGSAQAVLTQPSSVSGAPGQRVTISCTGSSSNIGDGYDVHWYQQLPGTAPKLLIYGNSNRPSGVPDRFSGSKSDTSASLAITGLQVEDEADYFCHSYDSSVSGWIFGGGTKLTVLG

SEQ ID NO: 1962 - protein, 249 aa, Homo sapiens
QVQLQESGPGLVKPSQTLSLTCTVSNGSINSGDYYWSWVRQPPGKGLEWIGYISNTGSTYYNPSLRSRLSMSLDTSKDQFSLEVTSLSAADTAVYYCASRPALRSLWYFDLWGQGTMVTVSSGGGGSGGGGSGGGGSAQSVLTQPPSVSAAPGQKVTIFCSGSSSNIGNNNIHWYQQLPGTAPKLLIYDSNKRPSGIPDRFSGSKSGTSGTLDITGLQTGDEADYSCATWDNSLNAYVFGSGTKVTVLG

SEQ ID NO: 1963 - protein, 248 aa, Homo sapiens
QVTLKESGGGLVKPGGSLRLSCAASGFTFSNAWMTWVRQAPGKGLEWVGRIKTKTDGGTTDYAAPVKGRFTISRDDSKNTVYLQMNSLQSEDTGVYYCTTLHCTGGSCGFWGRGTLVTVSSGGGGSGGGGSGGGGSAQSVLTQPPSASATPGQRVTISCSGSSSNIGINTVNWYQQLPGTAPKLLMYSDSQRPSGVPDRFSGSKSGTSASLAISGLQSEDEADYFCAAWDDSLNGVIFGGGTKLTVLG

SEQ ID NO: 1964 - protein, 253 aa, Homo sapiens
QVQLQQSGAEVKEPGASVKVSCKASGYTFTSYGISWVRQAPGQGLEWMGWISAYNGNTNYAQKLQGRVTMTTDTSTSTAYMELRSLRSDDTAVYYCARNPYYYDSSEGFFDYWGQGTMVTVSSGGGGSGGGGSGGGGSALDVVMTQSPLSLPVTLGQPASISCRSSQSLVYSDGNTYLNWFQQRPGQSPRRLIYKVSNRDSGVPDRFSGSGSGTDFTLKISRVEAEDVGVYYCMQATRWPFTFGQGTKMEIKR

SEQ ID NO: 1965 - protein, 248 aa, Homo sapiens
EVQLVQSGGGLVQPGGSLRLSCAACGFTFSSYEMNWVRQAPGKGLEWVSYISSSGSTIYYADSVKGRFTISRDNAKNSLYLQMNSLRAEDTAVYYCARSGRQAYYYYGMDVWGQGTLVTVSSGGGGSGGGGSGGGGSALSYVLTQPPSLSESPGQTAKITCSGDPLSKHYAYWYQQKSGLAPVLVMSKDNERPSGIPDRFYGSSSGTTATLTISGVQVEDEADYYCHSVGSDGSSLVFGGGTQLTVLS

SEQ ID NO: 1966 - protein, 254 aa, Homo sapiens
QVQLQESGPGLVEPSGTLSLTCAVSGASISSNNLWSWVRQPPGKGLEWIGEIYHSGSTSYNPSLRGRVTISVDKSTNQFSLKLTSVTDADTDVYYCARDYYDGSSYSSGDYYYYMDVWGQGTTVTVSSGGGGSGGGGSGGGGSALSYELTQPPSVSVSPGQTATITCSGDALPKQNAYWYQQKPGQAPVLVIYRDSERRSGIPERFSGSSSGTTATLTISGVQAEDEADYYCQSADSTVSYYVFGGGTKVTVLG

SEQ ID NO: 1967 - protein, 256 aa, Homo sapiens
QVQLQQSGAEVKKPGASVKVSCKASGYNFDSYYLHWVRQAPGQGLEWMGIINPSGASTYYAQKFQGRVTMTRDTSASTVYMELSSLRSEDTAVYYCARDSDLVVIPTAIQGRYYFDNWGQGTMVTVSSGGGGSGGGGSGGGGSAQAVLTQPSSVSGAPGQRVTISCTGSSSNIGDGYDVHWYQQLPGTAPKLLIYGNSHRPSGVPDRFSGSKSDTSASLAITGLQVEDEADYFCHSYDSSVSGWIFGGGTKVTVLG

SEQ ID NO: 1968 - protein, 249 aa, Homo sapiens
QVQLVQSGAEVKKPGSSVKVSCKASGGTFTSYAVTWVRQAPGQGLEWMGTVVPGFGTRKYAEKFQGRVTITADESTRAAYMELSSLKSEDTAVFYCARGKRYSYGWYFDIWGKGTLVTVSSGGGGSGGGGSGGGGSAQAVLTQPSSVSGAPGQRGTISCTGSSSNIGAGYDVHWYQQLPGTAPKLLIYGNSNRPSGVPDRFSGSKSGTSASLAITGLQAEDEADYYCHSYDSSLSAYVFGTGTKLTVLG

SEQ ID NO: 1969 - protein, 243 aa, Homo sapiens
EVQLVQSGGGVVQPGRSLRLSCAASGFTFSSYAMHWVRQAPGKGLEWVSAISGSGGSTYYADSVKGRFTISRDNSKNTLSLQMNSLRPEDTAVYYCVKDTPLDPWGRGTLVTVSSGGGGSGGGGSGGGGSAQSVLTQPPSVSGAPGQRVTISCTGGSSNIGADYDVHWYQQLPGAAPKLLIYANVNRPSGVPDRFSASKSGTSASLVITGLQAEDEADYYCQSYDSGLSASVFGGGTKLTVLG

SEQ ID NO: 1970 - protein, 249 aa, Homo sapiens
QVQLVQSGAEVKKPGASVKVSCTASGYNFTNNYMHWVRQAPGQGLEWMGIISPNTSNTKYAPKFQGRVTMTRDTSTATVYMELSTLRSEDTAIYYCAREGDPTDNDAFDVWGRGTMVTVSSGGGGSGGGGSGGGGSAQAVLTQPSSVSGAPGQRVTISCTGSSSNIGDGYDVHWYQQLPGTAPKLLIYGNTNRPSGVPDRFSGSKSDTSASLAITGLQVEDEADYFCHSYDSSMSGWIFGGGTKVTVLG

SEQ ID NO: 1971 - protein, 249 aa, Homo sapiens
EVQLMQSGAELKKPGASVKLSCKPSGYTVTPFYMHWVRQAPGQGLEWMGIIHSSSGNTAYAHNFQGRIAMISDTSTGSVYMELSGLRSDDTAVYYCATDGPTYARPYYLDHWGQGTLVTVSSGGGGSGGGGSGGGGSAQSVLTQPPSASGTPGQRVTISCSGDRSNIGSNYVLWYRQLPGPAPKVLIYNNSQRPSGVPARFSASRSGTSASLAISGLRSEDEADYYCAAWDDSLRGWVFGGGTKVTVLG

SEQ ID NO: 1972 - protein, 245 aa, Homo sapiens
EVQLVQSGAEVKKPGSSVKVSCKAPGNTFSSYGINWVRQAPGQGLEWVGGIFPIFDAVNYAEKFQGRVTITADESTTTAYMELNRLTSEDTAVYYCARDGTKYDWGFDYWGRGTMVTVSSGGGGSGGGGSGGGGSALEIVLTQSPSSVSASVGDRVSITCRASQGIGSWLFWYQQKPGKAPKLLISAVSGLQSGVPSRFSGSGSGTDFALTISSLQPEDFATYYCQQAHSFPITFGQGTRLEIKR

SEQ ID NO: 1973 - protein, 254 aa, Homo sapiens
QVQLVQSGVEVKKPGASVKVSCKASGYTFTSYGIVWVRQAPGQGLEWMGWMSPYNGYTNYARKFEGRVTMTRETSTTTAYMELRSLRSDDTAVYYCARETFSHCSGGSCYPFDYWGKGTLVTVSSGGGGSGGGGSGGGGSAQAVLTQPSSVSGAPGQRVTISCTGSSSNIGAGYDVHWYQQLPGTAPKLLIYGNSNRPSGVPDRFSGSKSGTSASLAITGLQAEDEADYYCQSYDNRLSGSDVFGTGTKVTVLG

SEQ ID NO: 1974 - protein, 248 aa, Homo sapiens
EVQLVQSGGGLVQPGGSLRLSCAASGFTFSSYEMNWVRQAPGKGLEWVSYISSSGSTIYYADSVKGRFTISRDNAKNSLYLQMNSLRAEDTAVYYCARSGRQAYYYYGMDVWGQGTLVTVSSGGGGSGGGGSGGGGSALSYVLTQPPSLSESPGQTAKITCSGDPLSKHYAYWYQQKSGLAPVLVMSKDNERPSGIPDRFYGSSSGTTATLTISGVQVEDEADYYCHSVGSDGSSLVFGGGTQLTVLS

SEQ ID NO: 1975 - protein, 246 aa, Homo sapiens
QVQLVQSGGGLVQPGGSLRLSCAASGFTFSSYAMSWVRQAPGKGLEWVSAISGSGGSTYYADSVKGRFTISRDNSKNTLYLQMNSLRAEDTAVYYCAKEFFGYVYLTDYWGRGTLVTVSSGGGGSGGGGSGGGGSALSSELTQDPAVSVALGQTVRITCQGDSLRSYYASWYQQKPGQAPVLVIYGKNNRPSGIPDRFSGSSSGNTASLTITGAQAEDEADYYCNSRDSSGNHLVFGTGTKLTVLG

SEQ ID NO: 1976 - protein, 248 aa, Homo sapiens
EVQLVETGGGLVKPGGSLRLSCAASGFTFSNAWMTWVRQAPGKGLEWVGRIKTKTDGGTTDYAAPVKGRFTISRDDSKNTVYLQMNSLQSEDTGVYYCTTLHCTGGSCGFWGRGTMVTVSSGGGGSGGGGSGGGGSAQAVLTQPSSASATPGQGVTISCSGSSSNIGSNTVNWYQQVPGTAPKLLIYGNNQRPSGVPERLSGSKSGTSASLAISGLQSEDEADYYCAAWDDSLNGVVFGGGTKLTVLG

SEQ ID NO: 1977 - protein, 250 aa, Homo sapiens
EVQLVQSGAEVKKPGSSVKVSCQASGGTFSNYAFTWVRQAPGQGLEWMGIFIPVFGTSYYTQNLEGRLTITADESTRTTYMDLRSLRREDTALYFCARVDYTDYEMGAFEIWGRGTLVTVSSGGGGSGGGGSGGGGSAQSVLTQPPSVSGAPGQRVTISCTGSSSNIGAGYDVHWYQQLPGKGPKVLMYDNNNRPSGVPDRFSGSKSGASASLAITGLQAEDEADYYCQSYDSSLDGYVFGTGTKVTVLG

SEQ ID NO: 1978 - protein, 247 aa, Homo sapiens
EVQLVETGGGLVQPGGSLRLSCAASGLTFSSYAMTWVRQAPGKGLEWVSAISGNGSNTYHADFVKGRFTASRDNSKSILYLQMNSLTADDSAVYYCAKVGNFGYYFEYWGQGTLVTVSSGGGGSGGGGSGGGGSAQSVLTQPPSVSGAPGQRVTISCTGSSSNIGAGYDVHWYQQLPRTAPKLLIFGNNNRPSGVPDRFSGSRSVTSASLVITGLQPDDEADYYCQSYDSSLSGWVFGGGTKLTVLG

SEQ ID NO: 1979 - protein, 245 aa, Homo sapiens
QVQLQESGGGLVQPGESLELSCATSGFSFSGAAIHWVRQASGKGLEWVGRIRNKGNNYATAYAASVEGRFTISRDESKNTAYLHLNSLKTEDTARYFCTKSSRNGGDYWGRGTLVTVSSGGGGSGGGGSGGGGSALSSELTQDPAVSVALGQTVRITCQGDSLRGNYATWYQQKPGQAPVLVFYGKNNRPSWIPDRFSGSRSGNTASLTISGAQAEDEADYYCNSRDTSGNHRVFGGGTKLTVLG

SEQ ID NO: 1980 - protein, 246 aa, Homo sapiens
QVQLVQSGGGLVQPGGSLRLSCAASGFTFSSYAMSWVRQAPGKGLEWVSAIRGSGGSTYYADSVKGRFTISRDNSKNTLYLQMNSLRAEDTAVYYCAKDLSRVAGRFDYWGKGTLVTVSSGGGGSGGGGSGGGGSALSSELTQDPTVSVALGQTVKITCQGDSLRNYYSSWYQQKPGQAPTLLIFGKNKRPSGIPGRFSGSNSGNTSSLTITGAQAEDEADYYCNSRDSSGTHLVFGGGTKVTVLG

SEQ ID NO: 1981 - protein, 247 aa, Homo sapiens
QLQLQESGPGLVKPLETLSLTCTVSGGSVSGRTHYWGWIRLPPGKGMEWIASLSFDGTPFYNPSLKSRVSVSRDTSKNQFSLKVTSVTAADTAVYYCARHDVYGDLFDYWGQGTMVTVSSGGGGSGGGGSGGGGSAQSVLTQPPSASGTPGQRVPISCSGSGSNIGSNSVSWYQQVPGTAPKLLIYNNNERPSGVPDRFSASKSGTSASLAISGLQSEDEADYYCASWDDSLTVPVFGGGTKLTVLG

SEQ ID NO: 1982 - protein, 248 aa, Homo sapiens
QVQLQESGGGLVTPGGSLRLSCAASGFTFSKAWMSWVRQAPGKGLEWVGRIKTKTDGGAPDYAAPVKGRFTISRDDSKNTVYLQMNSLKTEDAAVYYCSTLHCSGGSCGFWGKGTLVTVSSGGGGSGGGGSGGGGSAQSVLTQPPSASGTPGQRVSISCSGSTSNIGTNTVNWYRQLPGTAPKLLIYSNNQRPSGVPDRFSGSKSGTSVSLDISGLQSEDEADYFCAAWDGSRNGVVFGGGTKLTVLG

SEQ ID NO: 1983 - protein, 254 aa, Homo sapiens
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREGSIVGATLTINDAFDIWGKGTLVTVSSGGGGSGGGGSGGGGSAQSVVTQPPSVSGAPGQRVTISCTGSSSNIGDGYDVHWYQQLPGTAPKLLIYGNTNRPSGVPDRFSGSKSDTSASLAITGLQVEDEADYFCHSYDSSLSGWIFGGGTKVTVLG

SEQ ID NO: 1984 - protein, 249 aa, Homo sapiens
QVQLVQSGAEVKKPGSSVKISCKASGGTFSSYAISWVRQAPGQGLEWMGTVIPNSNIRKYAQKFQGRVTITADDSTRTAYMELSSLRSGDTAIFYCARGKRYSYGWYFDIWGRGTMVTVSSGGGGSGGGGSGGGGSAQAVLTQPSSVSGAPGQRVTISCTGSNSDIGAGYDVHWYQQLPGTAPKLLIYGNNNRPSGVPDRFSGSKSGTSASLAITELQAEDEADYYCQSYDSSLSGYVFGSGTKLTVLG

SEQ ID NO: 1985 - protein, 242 aa, Homo sapiens
QVQLVQSGAEVKKPGASVKVSCKASGYSFTDYFIHWVRQAPGQGLEWMGWINPKNGGTYFAQDFQGRVTMTGDTSIATAFMELSGLKSDDTAIYYCATDPFDYWGQGTLVTVSSGGGGSGGGGSGGGGSALSYELTQPPSVSGTPGQRVTISCSGSNSNIGINAVNWYKQLPGTAPKLLIYNNNQRPSWVRDRFSGSKDGTSVSLAISGLQSEDEADYYCASWDDSLNAYVFGGGTKVTVLG

SEQ ID NO: 1986 - protein, 249 aa, Homo sapiens
EVQLMQSGAELKKPGASVKLSCKPSGYTVTPFYMHWVRQAPGQGLEWMGIIHSSSGNTAYAHNFQGRIAMISDTSTGSVYMELSGLRSDDTAVYYCATDGPTYARPYYLDHWGQGTLVTVSSGGGGSGGGGSGGGGSAQSVLTQPPSASGTPGQRVTISCSGDRSNIGSNYVHWYRQLPGTAPKVLIYNNSQRPSGVPARFSASRSGTSASLAISGLRSEDEADYYCAAWDDSLRGWVFGGGTKVTVLG

SEQ ID NO: 1987 - protein, 253 aa, Homo sapiens
EVQLVQSGAEVKKPGASVRISCKASGYTFTYHYLHWVRQVPGRGLEWMGIINPRNYITTNAQTFQGRLSMTTDTSTSTVYMELSSLTSDDTGVYYCARESSGTLGEFSLELPFDYWGQGTMVTVSSGGGGSGGGGSGGGGSAQSVLTQPPSASGAPGQRVTFSCSGGSSNIGSSYVYWYRQLPGSAPKLVIYRNDQRPSGVPDRFSGFKSGTSASLAISGLRSEDEADYYCAAWDDRLRGLAFGGGTKLTVLG

SEQ ID NO: 1988 - protein, 248 aa, Homo sapiens
EVQLVQSGAEVKKPGSSVKGSCKSSGGTFSSYALSWVRQAPGQGLEWMGGIIPIFGTTNYAQKFQGRVTITADKSTSTAYMELSSLRSEDTAVYYCTTLGRNYTSSWSLDYWGRGTMVTVSSGGGGSGGGGSGGGGSALSSELTQDPAVSVALGQTVRITCQGDSLRSYYASWYQQKPRQAPVLVIYGKNDRPSGIPDRFSGSNSGNTASLTITGAQAEDEADYYCNSRDTSGNHLVFGTGTKLTVLG

SEQ ID NO: 1989 - protein, 240 aa, Homo sapiens
QVQLQQSGAGVRRPGTSVKISCKTSGYIFSQYPMHWVRQAPGQGLEWVAWIDTGNGSTRYSPNFQDRVTVTRDTSANTAYLELRSLRFTDTAVYYCATNAFDYWGKGTLVTVSSGGGGSGGGGSGGGGSALSSELTQDPAVSVALGQTVRITCQGDSLRNYYAGWYQQKPGQAPALVISGKNNRASGIPDRFSSSDSGNTASLTITGAQAEDEADYYCNSRDSSGNLIIFGGGTKVTVLG

SEQ ID NO: 1990 - protein, 250 aa, Homo sapiens
QVQLQESGPGLVKPSGTLSLTCAVSGGSISSPNWRSWVRQPPGKVLEWIGEIYHSGSINYNPSLKSRGTMSVDKSKNQFSLILNSVTAADTTVYYCARGRGYSSSSSVYGMDIWGQGTMVTVSSGGGGSGGGGSGGGGSALSSELTQDPAVSVALGQTVRITCQGDSLRTYYANWYQQKPGQAPVVVIYGKINRPSGIPDRFSGSSSGYTASLTITGAQAEDEADYYCNSGDRSGNHYVFGTGTKVTVLG

SEQ ID NO: 1991 - protein, 244 aa, Homo sapiens
EVQLVQSGGGLVKPGGSLRLSCAASGFTFSSYSMNWVRQAPGKGLEWVSSISSSSSHIYYADSVKGRFTISRDNAKNSLYLQMNSLRAEDTAVYYCARVHSSGSWGQGTLVTVSSGGGGSGGGGSGGGGSALDVVMTQSPLSLPVTLGQPASISCRSSQSLVHSDGNTYLNWFQQRPGQSPRRLIYKVSNRDFGVPDRFSGSGSGTYFTLKISRVEAEDVGVYYCMQGTHRITFGQGTRLEIKR

SEQ ID NO: 1992 - protein, 252 aa, Homo sapiens
QVQLVQSGAEVKKPGSSVMVSCKTSGGTFNNDGFSWVRQAPGQGLEWMGGIIPYFGTTHKAEKFQDRVTITADESAGTVLMELSSLRSEDSAIYYCARKRGDFGVIRLHHYYGMDVWGQGTLVTVSSGGGGSGGGGSGGGGSALSYELTQPPSVSVSPGQTARITCSGDALPNQYAYWYQQKPGQAPVLVIYKDSERPSGIPERFSGSSSGTTVTLTISGVQAEDEADYYCQAADSSSHVLFGGGTKLTVLG

SEQ ID NO: 1993 - protein, 247 aa, Homo sapiens
QLQLQESGPGLVKPSETLSLTCSVSGGSVSSRTQYWGWIRLPPGKGLEWIASLSFDGTTYYNPSLKSRVTLSRDMSKNHLSLNLNSVTDADTAVYYCARHDVYGDLFDSWGRGTMVTVSSGGGGSGGGGSGGGGSAQSVLTQPPSASGTPGQRVTLSCSGSSSNIEYNSVSWYQHLPGAAPKLLIYGNNQRPSGVPDRFSGSKSGTSASLAISGLQSEDEADYYCATWDDRLLNPVFGGGTKLTVLG

SEQ ID NO: 1994 - protein, 252 aa, Homo sapiens
QLQLQESGPGLVKPSQTLSLTCTVSGGSISSGDYYWSWIRQHPGEGLEWIGYIYHSGSTYYNPSLKSRVSMSVDTSKNQYSLKLSSVTAADTAVYYCARLRPDADYGDYGFDYWGQGTMVTVSSGGGGSGGGGSGGGGSALSYVLTQPPSASATPGQRVTISCSGSRSNIGSNYVYWYQQFPGAAPKLLIYRSYQRPSGVPDRFSGSKSGTSASLAISGLRSEDEADYYCATWDDRLRGLVFGGGTKVTVLG

SEQ ID NO: 1995 - protein, 248 aa, Homo sapiens
EVQLVQSGAEVKKPGESLKISCKASGYNFANYWIAWVRQTPGKGLQLMGIIYPGDSETKYSPSFQGQVTISADKSISTAYLQWSSLKASDSAMYYCARTSERGTYRQWDFDNWGQGTLVTVSSGGGGSGGGGSGGGGSAQSVLTQPPSVSVSPGQTASITCSGDKLGNKFASWYQQKPGQSPVLVIYQDMKRPSGIPERFSGSNSGNTATLTITGIQAMDEADYYCQAWDSSTAGYVFGTGTKLTVLG

SEQ ID NO: 1996 - protein, 246 aa, Homo sapiens
EVQLVQSGAEVKKPGASVKVSCKASGYSFTNYYMHWVRQAPGQGLEWMGIINPNGGRTSHAQKFQGRITMTKDTSTSMVYLELSSLRADDTAVYFCAREAGEVAAIDYWGRGTTVTVSSGGGGSGGGGSGGGGSAQSVVTQPPSASGTPGQRVTISCSGSRSNIASNYVNWYQQLPGTAPKLLIYKNNLRPSGVPDRFSGSKSGTSASLAISGLQSGDEADYYCETWDDRLNVVVFGGGTKLTVLG

SEQ ID NO: 1997 - protein, 249 aa, Homo sapiens
QVQLVQSGAEVKKPGSSVKVSCRASGGTFSTYAITWVRQAPGQGLEWMGTVIPSSGIRKYAQNFEGRVTIGADDSPTTAYMELSSLRSGDTAIFYCARGKRYSYGWYFDIWGRGTLVTVSSGGGGSGGGGSGGGGSAQAVLTQPSSVSGAPGQRVIISCTGSSPNIGAGYDVHWYQQLPGTAPKLLIYGNNNRPSGVPDRFSGSKSGTSASLAITGLQAADEADYYCQSYDSSLRGYVFGTGTKVTVLG

SEQ ID NO: 1998 - protein, 247 aa, Homo sapiens
QLQLQESDPGLVKPSETLSLTCSGSGGSVSSRTQYWGWIRLPPGKGLEWIASLSFDGTTYYNPSFKSRVTLSRDMSKNHLSLNLNSVTDADTAVYYCARHDVYGDLFDSWGRGTMVTVSSGGGGSGGGGSGGGGSAQSVLTQPPSASGTPGQRVTLSCSGSSSNIEYNSVSWYQHLPGAAPKLLIYGNNQRPSGVPDRFSGSKSGTSASLAISGLQSEDEADYYCATWDDRLLNPVFGGGTKLTVLG

SEQ ID NO: 1999 - protein, 249 aa, Homo sapiens
EVQLVQSGAEVKKPGSSVKISCEASGGTFSSYAISWVRQAPGQGLEWMGTVIPDSNIRKYAQKFQGRVTITADESPRTAYMELSSLRSGDTAIFYCARGKRYSYGWYFDVWGRGTLVTVSSGGGGSGGGGSGGGGSAQAVLTQPSSVSGAPGQRVTISCTGSSSNIGAGYDVHWFQKLPGTAPKLLIYGNTNRPSGVPDRFSGSKSGTSASLAITGLQAEDEADYYCQSYDRSLSGYVFGTGTKVTVLG

SEQ ID NO: 2000 - protein, 248 aa, Homo sapiens
EVQLVETGGGLVKPGGSLRLSCAASGFTFSNAWMTWVRQAPGKGLEWVGRIKTKTDGGTTDYPAPVKGRFTISRDDSKNTVYLQMSSLQSEDTGVYYCTTLHCTGGSCGFWGRGTMVTVSSGGGGSGGGGSGGGGSAQAVLTQPSSASATPGQGVTISCSGSSSNIGSNTVNWYQQVPGTAPKLLIYGNNQRPSGVPERLSGSKSGTSASLAISGLQSEDEADYYCAAWDDSLNGVVFGGGTKLTVLG

SEQ ID NO: 2001 - protein, 251 aa, Homo sapiens
EVQLVQSGTEVKKPGASMKVSCKSSGYTFTNYYIHWVRQAPGQGLEWMGIIDPTSGRTVYAQRFKGRVTMTRDTSTSTVYMELTSLKSEDTAVYFCARERGGRDGDYALDFWGQGTLVTVSSGGGGSGGGGSGGGGSALSYELTQPPSVSGAPGQRVTISCTGSSSNIGDGYDVHWYQQLPGTAPKLLIYGNANRPSGVPDRFSGSKPDTSASLAITGLQVEDEADYFCHSYDSNMSGWIFGGGTKVTVLG

SEQ ID NO: 2002 - protein, 249 aa, Homo sapiens
QLQLQESGPGLVKPSGTLSLTCAVSRGSTSSRNWWSWVRQFPEKGLEWIGEISHTGTTNYNPSLKGRVSISIDNSKNQFSLKMTSVTAADTAVYYCARRTPDHNGDSGPPDYWGQGTLVTVSSGGGGSGGGGSGGGGSALSSELTQDPAVSVALGQTVRITCQGDSLRTYYANWYQQKPGQAPVVVIYGKNNRPSGIPDRFSGSSSGYTASLTITGAQAEDEADYYCNSGDRSGNHYVFGTGTKLTVLG

SEQ ID NO: 2003 - protein, 237 aa, Homo sapiens
QVQLVQSGGGLVQPGGSLRLSCAASGFTFSSYEMNWVRQAPGKGLEWVSYISSSGSTIYYADSVKGRFTISRDNAKNSLYLQMNSLRAEDTAVYYCARDTTDYWGKGTLVTVSSGGGGSGGGGSGGGGSDIVMTQSPSTLSASVGDRVTITCRASQGISSWLAWYQQKPGRAPKVLIYKASTLESGVPSRFSGSGSGTDFTLTISSLQPEDFATYYCQQSYSTPWTFGQGTKLEIKR

SEQ ID NO: 2004 - protein, 245 aa, Homo sapiens
QVQLQESGAEVKKPGASVKVSCKASGYTFTGYYMHWVRQAPGQGLEWMGWINPNSGGTNYAQKFQGRVTMTRDTSISTAYMELSRLRSDDTAVYYCARESLTGGAFDIWGRSTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 2005 - protein, 237 aa, Homo sapiens
QVQLVQSGGGLVQPGGSLRLSCAASGFTFSSYEMNWVRQAPGKGLEWVSYISSSGSTIYYADSVKGRFTISRDNAKNSLYLQMNSLRAEDTAVYYCARDTTDYWGQGTLVTVSSGGGGSGGGGSGGGGSDIVMTQSPSTLSASVGDRVTITCRASQGISSWLAWYQQKPGRAPKVLIYKASTLESGVPSRFSGSGSGTDFTLTISSLQPEDFATYYCQQSYSTPWTFGQGTKLEIKR

SEQ ID NO: 2006 - protein, 237 aa, Homo sapiens
QVQLVQSGGGLVQPGGSLRLSCAASGFTFSSYEMNWVRQAPGKGLEWVSYISSSGSTIYYADSVKGRFTISRDNAKNSLYLQMNSLRAEDTAVYYCARDTTDYWGQGTMVTVSSGGGGSGGGGSGGGGSSELTQDPAVSVALGQTVRITCQGDSLRSYYASWYQQKPGQAPVLVIYGKNNRPSGIPDRFSGSGSGNTASLTITGAQAEDEADYYCNPRDSSGNHVVFGGGTKLTVLG

SEQ ID NO: 2007 - protein, 240 aa, Homo sapiens
QVQLVQSGGGLVQPGGSLRLSCAASGFTFSSYEMNWVRQAPGKGLEWVSYISSSGSTIYYADSVKGRFTISRDNAKNSLYLQMNSLRAEDTAVYYCARDTTDYWGRGTMVTVSSGGGGSGGGGSGGGGSQSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLG

SEQ ID NO: 2008 - protein, 241 aa, Homo sapiens
QVQLQESGAEVKKPGASVKVSCKASGYTFTGYYMHWVRQAPGQGLEWMGWINPNSGGTNYAQKFQGRVTMTRDTSISTAYMELSRLRSDDTAVYYCARGAGSRYFDLWGQSTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCHSRDSSGNHVLFGGGTKLTVLG

SEQ ID NO: 2009 - protein, 243 aa, Homo sapiens
GVQLVESGAEVKKPGASVKVSCKASGYTFTGYYMHWVRQAPGQGLEWMGWINPNSGGTNYAQKFQGRVTMTRDTSISTAYMELSRLRSDDTAVYYCARGGDRAFDIWGRSTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTVSGLQAEDEADYYCSSYTTRSTRVFGGGTKLTVLG

SEQ ID NO: 2010 - protein, 236 aa, Homo sapiens
QVQLVQSGGGLVQPGGSLRLSCAASGFTFSSYEMNWVRQAPGKGLEWVSYISSSGSTIYYADSVKGRFTISRDNAKNSLYLQMNSLRAEDTAVYYCARDTTDYWGQGTMVTVSSGGGGSGGGGSGGGGSSELTQDPAVSVALGQTVRITCQGDSLRSYYASWYQQKPGQASVLVIYGKNNRPSGIPDRFSGSSSGNTASLTITGAQAEDEADYYCSSYTTRSTRVFGGGTKLTVLG

SEQ ID NO: 2011 - protein, 244 aa, Homo sapiens
GVQLVESGAEVKKPGASVKVSCKASGYTFTGYYMHWVRQAPGQGLEWMGWINPNSGGTNYAQKFQGRVTMTRDTSISTAYMELSRLRSDDTAVYYCARGNAWGAFDIWGRSTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTVSGLQAEDEADYYCSSYTTRSTRVFGGGTKLTVLG

SEQ ID NO: 2012 - protein, 243 aa, Homo sapiens
QVQLQESGAEVKKPGASVKVSCKASGYTFTGYYMHWVRQAPGQGLEWMGWINPNSGGTNYAQKFQGRVTMTRDTSISTAYMELSRLRSDDTAVYYCARGGDRAFDIWGRSTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLAVLG

SEQ ID NO: 2013 - protein, 240 aa, Homo sapiens
QVQLVQSGGGLVQPGRSLRLSCAASGFTFSSYAMSWVRQAPGKGLEWVSVINGSGGSTYYADSVKGRFTISRDNSKNTLYLQMNSLRAEDTAVYYCAKVKRYYFDYWGRGTMVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 2014 - protein, 243 aa, Homo sapiens
QVNLRESGAEVKKPGASVKVSCKASGYTFTGYYMHWVRQAPGQGLEWMGWINPNSGGTNYAQKFQGRVTMTRDTSISTAYMELSRLRSDDTAVYYCARELTGANDAFDIWGRSTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 2015 - protein, 239 aa, Homo sapiens
EVQLVESGGGLVKPGGSLRLSCAASGFTFDDYGMSWVRQAPGKGLEWVSGINWNGGSTGYADSVKGRFTISRDNAKNSLYLQMNSLRAEDTAVYYCARRRYALDYWGRGTLVTVSSGGGGSGGGGSGGGGSSELTQDPAVSVALGQTVRITCQGDSLRSYYASWYQQTPGQAPVLVIHGKNNRPSGIPDRFSGSSSGNTASLTITGAQAEDEADYYCNSRDSSGNHVVFGGGTKLTVLG

SEQ ID NO: 2016 - protein, 240 aa, Homo sapiens
QVQLVQSGGGLVQPGGSLRLSCAASGFTFSSYEMNWVRQAPGKGLEWVSYISSSGSTIYYADSVKGRFTISRDNAKNSLYLQMNSLRAEDTAVYYCARDTTDYWGQGTLVTVSSGGGGSGGGGSGGGGSQSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLG

SEQ ID NO: 2017 - protein, 237 aa, Homo sapiens
QVQLVQSGGGLVQPGGSLRLSCAASGFTFSSYEMNWVRRAPGKGLEWVSYISSSGSTIYYADSVKGRFTISRDNAKNSLYLQMNSLRAEDTAVYYCARDTTDYWGQGTLVTVSSGGGGSGGGGSGGGGSDIVMTQSPSTLSASVGDRVTITCRASQGISSWLAWYQQKPGRAPKVLIYKASTLESGVPSRFSGSGSGTDFTLTISSLQPEDFATYYCQQSYSTPWTFGQGTKLEIKR

SEQ ID NO: 2018 - protein, 239 aa, Homo sapiens
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCARGFALYKDWGQGTLVTVSRGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 2019 - protein, 237 aa, Homo sapiens
QVQLVQSGGGLVQPGGSLRLSCAASGFTFSSYEMNWVRQAPGKGLEWVSYISSSGSTIYYADSVKGRFTISRDNAKNSLYLQMNSLRAEDTAVYYCARDTTDYWGRGTMVTVSSGGGGSGGGGSGGGGSDIVMTQSPSTLSASVGDRVTITCRASQGISSWLAWYQQKPGRAPKVLIYKASTLESGVPSRFSGSGSGTDFTLTISSLQPEDFATYYCQQSYSTPWTFGQGTKLEIKR

SEQ ID NO: 2020 - protein, 237 aa, Homo sapiens
EVQLVQSGGGLVQPGGSLRLSCAASGFTFSSYEMNWVRQAPGKGLEWVSYISSSGSTIYYADSVKGRFTISRDNAKNSLYLQMNSLRAEDTAVYYCARDTTDYWGQGTLVTVSSGGGGSGGGGSGGGGSDIVMTQSPSTLSASVGDRVTITCRASQGISSWLAWYQQKPGRAPKVLIYKASTLESGVPSRFSGSGSGTDFTLTISSLQPEDFATYYCQQSYSTPWTFGQGTKLEIKR

SEQ ID NO: 2021 - protein, 242 aa, Homo sapiens
QVNLRESGAEVKKPGASVKVSCKASGYTFTGYYMHWVRQAPGQGLEWMGWINPNSGGTNYAQKFQGRVTMTRDTSISTAYMELSRLRSDDTAVYYCAREDLTGDAFDIWGRSTLVTVSSGGGGSGGGGSGGGGSSELTQNPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 2022 - protein, 239 aa, Homo sapiens
QVQLVESGGGVVQPGRSLRLSCAASGFTFSSYGMHWVRQAPGKGLEWVSAISGSGGSTYYADSVKGRFTISRDNSKNTLYLQMNSLRAEDTAVYYCARGDAYFDYWGRGTMVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCHSRDSSGNHVLFGGGTKLTVLG

SEQ ID NO: 2023 - protein, 239 aa, Homo sapiens
QVQLQESGGGVVQPGGSLRLSCAASGFTFSGYGMHWVRQAPGKGLEWVSAISGSGGSTYYADSVKGRFTISRDNAKNSLYLQMNSLRAEDTAVYYCARGDAYFDYWGQGTMVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCHSRDSSGNHVLFGGGTKLTVLG

SEQ ID NO: 2024 - protein, 238 aa, Homo sapiens
QVQLVQSGGGLVQPGGSLRLSCAASGFTFSSYEMNWVRQAPGKGLEWVSYISSSGSTIYYADSVKGRFTISRDNAKNSLYLQMNSLRAEDTAVYYCARDTTDYWGQGTLVTVSSGGGGSGGGGSGGGGSQSVLTQDPAVSVALGQTVRITCQGDSLRSYYASWYQQKPGQAPVLVIYGKNNRPSGIPDRFSGSSSGNAASLTITGAQAEDEADYYCNSRDSSGNHVVFGRGTKLTVLG

SEQ ID NO: 2025 - protein, 240 aa, Homo sapiens
QVQLVQSGGGLVQPGGSLRLSCAASGFTFSSYEMNWVRQAPGKGLEWVSYISSSGSTIYYADSVKGRFTISRDNAKNSLYLQMNSLRAEDTAVYYCARDTTDYWGRGTLVTVSSGGGGSGGGGSGGGGSQSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLG

SEQ ID NO: 2026 - protein, 244 aa, Homo sapiens
GVQLVESGAEVKKPGASVKVSCKASGYTFTGYYMHWVRQAPGQGLEWMGWINPNSGGTNYAQKFQGRVTMTRDTSISTAYMELSRLRSDDTAVYYCAREGLLDAFDIWGRSTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 2027 - protein, 237 aa, Homo sapiens
QVQLVQSGGGLVQPGGALRLSCAASGFTFSSYEMNWVRQAPGKGLEWVSYISSSGSTIYYADSVKGRFTISRDNAKNSLYLQMNSLRAEDTAVYYCARDTTDYWGQGTLVTVSSGGGGSGGGGSGGGGSDIVMTQSPSTLSASVGDRVTITCRASQGISSWLAWYQQKPGRAPKVLIYKASTLESGVPSRFSGSGSGTDFTLTISSLQPEDFATYYCQQSYSTPWTFGQGTKLEIKR

SEQ ID NO: 2028 - protein, 237 aa, Homo sapiens
QVQLVQSGGGLVQPGGSLRLSCATSGFTFSSYEMNWVRQAPGKGLEWVSYISSSGSTIYYADSVKGRFTISRDNAKNSLYLQMNSLRAEDTAVYYCARDTTDYWGQGTMVTVSSGGGGSGGGGSGGGGSDIVMTQSPSTLSASVGDRVTITCRASQGISSWLAWYQQKPGRAPKVLIYKASTLESGVPSRFSGSGSGTDFTLTISSLQPEDFATYYCQQSYSTPWTFGQGTKLEIKR

SEQ ID NO: 2029 - protein, 240 aa, Homo sapiens
QVQLVQSGGGLVQPGGSLRLSCAASGFTFSSYEMNWVRQAPGKGLEWVSYISSSGSTIYYADSVKGRFTISRDNAKNSLYLQMNSLRAEDTAVYYCARDTTDYWGKGTLVTVSSGGGGSGGGGSGGGGSQSVLTQPPSASGTPGQRVTISCSGSSSNIGSNTVNWYQRLPGAAPQLLIYNNDQRPSGIPDRFSGSKSGTSGSLVISGLQSEDEADYYCASWGDSLNGRVFGGGTKLTVLG

SEQ ID NO: 2030 - protein, 240 aa, Homo sapiens
QVQLVQSGGGLVQPGGSLRLSCAASGFTFSSYEMNWVRQAPGKGLEWVSYISSSGSTIYYADSVKGRFTISRDNAKNSLYLQMNSLRAEDTAVYYCARDTTDYWGQGTMVTVSSGGGGSGGGGSGGGGSQSVLTQPPSASGTPGQRVTISCSGSSSNIGSNTVNWYQRLPGAAPQLLIYNNDQRPSGIPDRFSGSKSGTSGSLVISGLQSEDEADYYCASWDGSLNGRVFGGGTKLTVLG

SEQ ID NO: 2031 - protein, 241 aa, Homo sapiens
QVQLVQSGAEVKKPGASVKVSCKASGYTFTGYYMHWVRQAPGQGLEWMGWMNPNSGNTGYAQKFQGRVTMTRNTSISTAYMELSSLRSEDTAVYYCARVGYGGKGDYWGRGTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 2032 - protein, 241 aa, Homo sapiens
QVQLQESGAEVKKPGASVKVSCKASGYTFTGYYMHWVRQAPGQGLEWMGWINPNSGGTNYAQKFQGRVTMTRDTSISTAYMELSRLRSDDTAVYYCARGAGSRYFDLWGRSTLVTVSSGGGGSGGGGSGGGGSSELTQDPAVSVALGQTVRITCQGDSLRSYYASWYQQKPGQAPLLVVYAKNKRPSGIPDRFSGSSSGNTASLTITGAQAEDEADYYCHSRDSSGNHVLFGGGTKLTVLG

SEQ ID NO: 2033 - protein, 249 aa, Homo sapiens
QVTLKESGAEVKKPGASVKVSCKASGYTFTDYHMHWVRQAPGQGLEWMGWINPNSGDTNYVKKFQGRVTMTRDTSVSTAYMELSRLTSDDTAVYYCARGLAPIVDGGMTNDAFDIWGRSTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 2034 - protein, 239 aa, Homo sapiens
QVQLVQSGGGLVQPGGSLRLSCAASGFTFSSYEMNWVRQAPGKGLEWVSYISSSGSTIYYADSVKGRFTISRDNAKNSLYLQMNSLRAEDTAVYYCARDTTDYWGQGTMVTVSSGGGGSGGGGSGGGGSQSVLTQPPSASGTPGQRVTISCSGSSSNIGSNTVNWYQRLPGAAPQLLIYNNDQRPSGIPDRFSGSKSGNTASLTISGLQAEDEADYYCSSYTTRSTRVFGGGTKLTVLG

SEQ ID NO: 2035 - protein, 239 aa, Homo sapiens
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCARRLIRKARWGQGTLVTVSSGGGGSGGGGSGGGGSSELTQDPVVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 2036 - protein, 237 aa, Homo sapiens
QVQLVQSGGGLVQPGGSLRLSCAASGFTFSSYEMNWVRQAPGKGLEWVSYISSSGSTIYYADSVKGRFTISRDNAKNSLYLQMNSLRAEDTAVYYCARDTTDYWGQGTMVTVSSGGGGSGGGGSGGGGSSELTQDPAVSVALGQTVRITCQGDSLRSYYASWYQQKPGQAPVLVIYAKNKRPSGIPDRFSGSSSGNTASLTITGAQAEDEADYYCHSRDSSGNHVLFGGGTKLTVLG

SEQ ID NO: 2037 - protein, 244 aa, Homo sapiens
EVQLVESGAEVKKPGASVKVSCKASGYTFTGYYMHWVRQAPGQGLEWMGWINPNSGGTNYAQKFQGRVTMTRDTSISTAYMELSRLRSDDTAVYYCARERGNQAFDIWGRSTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 2038 - protein, 239 aa, Homo sapiens
EVQLVESGGGVVRPGGSLRLSCAASGFTFDDYGMSWVRQAPGKGLEWVSGINWNGGSTGYADSVKGRFTISRDNAKNSLYLQMNSLRAEDTAVYYCARRRYALDYWGQGTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 2039 - protein, 237 aa, Homo sapiens
QVQLVQSGGGLVQPGGSLRLSCAASGFTFSSYEMNWVRQAPGKGLEWVSYISSSGSTTYYADSVKGRFTISRDNAKNSLYLQMNSLRAEDTAVYYCARDTTDYWGRGTMVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFDGGTKLTVLG

SEQ ID NO: 2040 - protein, 237 aa, Homo sapiens
QVQLVQSGGGLVQPGGSLRLSCAASGFTFSSYEMNWVRQAPGKGLEWVSYISSSGSTIYYADSVKGRFTISRDNAKNLLYLQMNSLRAEDTAVYYCARDTTDYWGRGTLVTVSSGGGGSGGGGSGGGGSDIVMTQSPSTLSASVGDRVTITCRASQGISSWLAWYQQKPGRAPKVLIYKASTLESGVPSRFSGSGSGTDFTLTISSLQPEDFATYYCQQSYSTPWTFGQGTKLEIKR

SEQ ID NO: 2041 - protein, 240 aa, Homo sapiens
QVQLVQSGGGLVQPGGSLRLSCAASGFTFSSYEMNWVRQAPGKGLEWVSYISSSGSTIYYADSVKGRFTISRDNAKNSLYLQMNSLRAEDTAVYYCARDTTDYWGQGTLVTVSSGGGGSGGGGSGGGGSQSVLTQPASVSGTPGQRVTISCSGSSSNIGSNTVSWYQRLPGAAPQLLIYNNDQRPSGIPDRFSGSKSGTSGSLVISGLQSEDEADYYCASWDDSLNSRVFGGGTKLTVLG

SEQ ID NO: 2042 - protein, 245 aa, Homo sapiens
AVQLVESGAEVKKPGASVKVSCKASGYTFTGYYMHWVRQAPGQGLEWMGWINPNSGGTNYAQKFQGRVTMTRDTSISTAYMELSRLRSDDTAVYYCARSRSPYDAFDIWGRSTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 2043 - protein, 237 aa, Homo sapiens
QVQLVQSGGGVVQPGRSLRLSCAASGFTFSSYEMNWVRQAPGKGLEWVSYISSSGSTIYYADSVKGRFTISRDNAKNSLYLQMNSLRAEDTAVYYCARDTTDYWGQGTLVTVSSGGGGSGGGGSGGGGSDIVMTQSPSTLSASVGDRVTITCRASQGISSWLAWYQQKPGRAPKVLIYKASTLESGVPSRFSGSGSGTDFTLTISSLQPEDFATYYCQQSYSTPWTFGQGTKLEIKR

SEQ ID NO: 2044 - protein, 240 aa, Homo sapiens
QVQLVQSGGGLVQPGGSLRLSCAASGFTFSSYEMNWVRQAPGKGLEWVSYISSSGSTIYYADSVKGRFTISRDNAKNSLYLQMNSLRAEDTAVYYCARDTTDYWGQGTMVTVSSGGGGSGGGGSGGGGSQSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLG

SEQ ID NO: 2045 - protein, 240 aa, Homo sapiens
QVQLVQSGGGLVQPGGSLRLSCAASGFTFSSYEMNWVRQAPGKGLEWVSYISSSGSTIYYADSVKGRFTISRDNAKNSLYLQMNSLRAEDTAVYYCARDTTDYWGKGTLVTVSSGGGGSGGGGSGGGGSQSVLTQPPSASGTPGQRVTISCSGSSTNIGSNTVNWYQRLPGAAPQLLIYNNDQRPSGIPDRFSGSKSGTSGSLVISGLQSEDEADYYCASWDDSLNGRVFGGGTKLTVLG

SEQ ID NO: 2046 - protein, 242 aa, Homo sapiens
GVQLVESGAEVKRPGASVKVSCKASGYTFTGYYMHWVRQVPGQGLEWMGWINPNSGGTNYAQKFQGRVTMTRDTSISTAYMELSRLRSDDTAVYYCARSNWGGDAFDIWGRSTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 2047 - protein, 240 aa, Homo sapiens
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCASLAFDIWGKSTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 2048 - protein, 240 aa, Homo sapiens
QVQLVQSGGGLVQPGGSLRLSCAASGFTFSSYEMNWVRQAPGKGLEWVSYISSSGSTIYYADSVKGRFTISRDNAKNSLYLQMNSLRAEDTAVYYCARDTTDYWGQGTLVTVSSGGGGSGGGGSGGGGSQSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTELTVLG

SEQ ID NO: 2049 - protein, 249 aa, Homo sapiens
QVQLVQSGAEVKEPGASVKISCEASGYTFTNNFIDWVRQAPGQGLEWMGTISGSTGNTYYKQGFQGRVTMTRDTATSTAYLEVRGLTSEDTAIYFCARPAASSRGPKDAFDIWGQGTLVTVSSGGGGSGGGGSGGGGSQSVLTQPPSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLG

SEQ ID NO: 2050 - protein, 240 aa, Homo sapiens
QVQLQQSGGGLLQPGGSLRLSCAASGFAFKNYAMSWVRQAPGKGLEWVSTISDSGGLTHSADSLKGRVTVSRDNSENTLYLQMNSLRAEDTAVYYCARLSGDSWGQGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 2051 - protein, 243 aa, Homo sapiens
QVQLQQSGGGLVQPGGSLRLSCAASGFTFSHYWMTWVRQAPGKGLEAEASIKRDGSQQYYLDSVKGRFTISRDNAKNSLSLQMSSLRAEDTAVYYCAREGVAAGEDYWGRGTLVTVSSGGGGSGGGGSGGGGSQSVLTQPPSVSAAPGQKVTISCSGSNSNIGNNYVSWYQQHPGKVPKLMIYEGSKRPSGVSNRFSASKSGNTASLTISGLQAEDEADYYCSSYTSSSTYAFGTGTKLTVLG

SEQ ID NO: 2052 - protein, 240 aa, Homo sapiens
GVQLVESGGGLVKPGGSLRLSCATSGFRFSDYAMTWVRQAPGKGLEWVSSITGRGGGTHYAGSVRGRFTISRDNSKNTVYLQMNNLRPEDTAVYYCASFVLDYWGKGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 2053 - protein, 238 aa, Homo sapiens
QVQLQQWGGGVVQPGRSLRLSCAASGSTFSTYSMHWVRQAPGKGLEWVASISYDGSIKYYADSVKGRFTISRDNSKNTLYLQMNSLRAEDTAVYYCAKGNGKDVWGRGTLVTVSSGGGGSGGGGSGGGGSDIVMTQSPSTLSASVGDRVTITCRASQGISSWLAWYQQKPGRAPKVLIYKASTLESGVPSRFSGSGSGTDFTLTISSLQPEDFATYYCQQSYSTPWTFGQGTKLEVKR

SEQ ID NO: 2054 - protein, 241 aa, Homo sapiens
QVQLVQSGGGLVQPGGSLRLSCEASGFTFSHYWMTWVRQAPGKGLEAVASIKRDGSQQYYLDSVKGRFTISRDNAKNSLSLQMSSLRAEDTAVYYCAREGVAAGEDYWGRGTMVTVSSGGGGSGGGGSGGGGSDVVMTQSPSSVSASVGDRVTITCRASQGISSYLAWYQQKPGKAPKLLIYAASTLQSGVPSRFSGSGSGTDFTLTISTLQPEDVATYYCENYNSVPLSFGGGTKLEIKR

SEQ ID NO: 2055 - protein, 241 aa, Homo sapiens
QVQLVQSGGDVVQPGRSLRLSCAASGFTYSSYAMHWVRQAPGKGLEWVAVISYDGSNKYYADSVKGRFTISRDNSKNTLYLQMNSLRAEDTAVYYCARDLDFDYWGQGTLVTVSSGGGGSGGGGSGGGGSQSVLTQPPSASGSPGQSVTISCTGTSSDVGGYNYVSWYQQHPGKAPKFMIYDVSKRPSGVSNRFSGSKSGNTASLTISGVQAEDEADYYCSSYTSASTVIFGGGTKLTVLG

SEQ ID NO: 2056 - protein, 243 aa, Homo sapiens
QVQLVQSGGNLVQPGGSLRLSCAASGFTFSSYAMSWVRQAPGKGLEWVSAISGSGGSTYYADSVKGRFTISRDNAKNSLYLQMNSLRDEDTAVYYCARVNDIVVVDMDVWGRGTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 2057 - protein, 243 aa, Homo sapiens
EVQLVQSGGGVVQPGRSLRLSCAASGFTFRTYGMHWVRQAPGKGLEWVAAIWHDGSNKYYADSVRGRFTISRDNSKNTLYLQMNSLRPDDTAVYYCAREKRGSRRVFDIWGRGTLVTVSSGGGGSGGGGSGGGGSSELTQDPAVSVALGQTVRITCQGDSLRSYYTNWFQQKPGQAPLLVVYAKNKRPSGIPDRFSGSSSGNTASLTITGAQAEDEADYYCNSRDSSGNHVVFGGGTKLTVLG

SEQ ID NO: 2058 - protein, 244 aa, Homo sapiens
EVQLVQSGPQVKKPGSPVKVSCKASGVTFSSTAFSWVRQAPGQGLEWVGGIIPIFGKSIYAQKSQGRVTISADTSTSTVYMEVTSLTSEDTAVYYCVTLSNRNDNLRLDYWGQGTTVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 2059 - protein, 240 aa, Homo sapiens
GVQLVESGGGLGKPGGSLRLSCATSGFRFSDYAMTWVRQAPGKGLEWVSSITGSGGGTHYAGSVRGRFTISRDNSKNTVYLQMNNLRPEDTAVYYCASFVLDYWGKGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 2060 - protein, 241 aa, Homo sapiens
QVQLVETGGNLVQPGGSLRLSCPTSGFTFSSYAMTWVRQAPGKGLEWVSAISGSGGSTYYADSVKGRFTISRDNSKNTLYLQMSSLRAEDTAIYYCTLTWATNTFDMWGRGTMVTVSSGGGGSGGGGSGGGGSSELTQDPAVSVALGQTVRITCQGDSLRSYYASWYQQKPGQAPVLVIYGKSTRPSGIPDRFSGSSSGNTASLTITGAQAEDEADYYCNSRDSSGNHVVFGGGTKLTVLG

SEQ ID NO: 2061 - protein, 240 aa, Homo sapiens
EVQLVESGGGLVKPGGSLRLSCATSGFRFSDYAMTWVRQAPGKGLEWVSSITGSGGGTHYAGSVRGRFTISRDNSKNTVYLQMNNLRPEDTAVYYCASFDLDYWGQGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 2062 - protein, 246 aa, Homo sapiens
QVQLVQSGAEVKKPGSSVKISCKASGGSLHNYAISWVRQAPGQGLEWMGGIIPIFGTANYAQKFQGRVTITADESTSTAYMELSGLRSEDTAVYYCARVEWEDIVVGSAFDIWGQGTMVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKR

SEQ ID NO: 2063 - protein, 243 aa, Homo sapiens
QVRLVQSGGEVKKPGASVKVSCKASGYTFTGYYMHWVRQAPGQGLEWMGWINPNSGGTNYAQKFQGWVTMTRDTSTSTVYMELSSLRSEDTALYYCARGGDMTTVTTDYWGRGTLVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKR

SEQ ID NO: 2064 - protein, 243 aa, Homo sapiens
EVQLVQSGAEVKKAGESLKISCKGSGYTFTSYGITWVRQAPGQGLEWMGWISGYNANTTYAQNLQGRVTMTRDTSTSTVYMELRSLRSDDTDVYYCARADYSNDYYMDVWGKGTMVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSDYPLTFGGGTKLEIKR

SEQ ID NO: 2065 - protein, 249 aa, Homo sapiens
QVQLVQSGGGLVQPGGSLRLSCEASGFTFSHYWMTWVRQAPGKGLEAVASIKRDGSQQYYLDSVKGRFTISRDNAKNSLSLQMSSLRAEDTAVYYCAREGVAAGEDYWGRGTIVTVSSGGGGSGGGGSGGGGSAASAQSVVTQPPSASGSPGQSVTISCTGTSSDIGSYNYVSWYQQHPGKAPKLMIYDVSKRPSGVPDRFSGSKSGNSASLDISGLQSEDEADYYCAAWDDSLSEFLFGTGTKLTVLG

SEQ ID NO: 2066 - protein, 250 aa, Homo sapiens
EVQLVQSGAEVKKPGSSVKVSCKASGDTFSSYAFSWVRQAPGQGLEWMGGIIPIFGATNYAQKFQGRVTISADESTGTAYMELSSLRSEDTAVYYCARGPIYYFDGSAYEGYYFDYWGRGTMVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 2067 - protein, 238 aa, Homo sapiens
EVQLVQSGGGLVQPGGSLRLSCAASGFPFSAYAMSWVRQAPGKGLEWVSTLYADGPIYYADSVKGRFTISRDDSKNTLYLQMNRLRVEDTAVYYCASMNADAFEIWGQGTMVTVSSGGGGSGGGGSGGGGSSELTQDPAVSVALGQTVRITCQGDSLRSYYTNWFQQKPGQAPLLVVYAKNKRPSGIPDRFSGSSSGNTASLTITGAQAEDEADYYCQSYDSSRGWVFGGGTKLTVLG

SEQ ID NO: 2068 - protein, 246 aa, Homo sapiens
QVQLVQSGAEVKEPGASVKISCEASGYTFTNNFIDWVRQAPGQGLEWMGTISGSTGNTYYKQGFQGRVTMTRDTATSTAYLEVRGLTSEDTAIYFCARPAASSRGPKDAFDIWGQGTLVTVSSGGGGSGGGGSGGGGSSELTQDPAVSVALGQTVRITCQGDSLRSYYTNWFQQKPGQAPLLVVYAKNKRPSGIPDRFSGSSSGNTASLTITGAQAEDEADYYCNSRDSSGNHVVFGGGTKLTVLG

SEQ ID NO: 2069 - protein, 244 aa, Homo sapiens
QVQLQQSGAEVKKPGSSVKVSCKASGGTFSSYAINWVRQAPGQGLEWMGGIIPIFGTTKHAQKFQGRVSITADESTSTAYMVLSSLSSEDTAVYYCARDSRPTNRAFHYWGQGTMVTVSSGGGGSGGGGSGGGGSAQPVLTQPPSVSVSPGQTASITCSGDKLGDVYTSWYQQKSGQSPVLVIYQDSKRPSGIPGRFSGSNSGNTATLTITGTQAMDEADYFCQAWDTRNAWIFGGGTKVTVLG

SEQ ID NO: 2070 - protein, 248 aa, Homo sapiens
EVQLVETGGGLVKPGGSLRLSCAASGFTFSNAWMTWVRQAPGKGLEWVGRIKTKTDGGTTDYAAPVKGRFTISRDDSKNTVYLQMNSLQSEDTGVYYCTTLHCTGGSCGFWGQGTMVTVSSGGGGSGGGGSGGGGSAQSVVTQPPSASATPGQRVTISCSGTTSNIGINTVNWYQQLPGTAPRLLIYGDSQRPSGVPDRFSGSKSGTSASLAISELQSEDEADYFCAVWDDSLNGVIFGGGTKVTVLG

SEQ ID NO: 2071 - protein, 248 aa, Homo sapiens
EVQLVQSGAEVKKPGASVKVSCKASGYIITGNYIHWVRQAPGQGPEWMGWINPNSGATKYAQNFQGRVTMTRDTSISTAYMELSSLRSDDTAVYYCARVRDDSAGFDYWGKGTLVTVSSGGGGSGGGGSGGGGSAQSVLTQPPSVSGAPGQRVTISCTGSSSNIGAGYAVHWYQQLPGTAPRLLIYGNTNRPSGVPDRFSGSKSATSGSLAISGLQAEDEAEYFCQSYDTSLSGAFVFGTGTKVTVLG

SEQ ID NO: 2072 - protein, 247 aa, Homo sapiens
QVQLVQSGAEVKKPGTSVKVSCQASGGSLSRYAFSWVRQAPGQGPEWLGGIIPTFGTAHYAQKFQDRVTISADESTSTVYMELSRLTSDDTAIYFCARVLVRGQYRGMDLCCKGTMVVVTSGGGGSGGGGSGGGGSALYSELTQDPTVSVALGQTVRITCHGDSLKNYHASWYQQKSGQAPVLVIYSNNKRPSGIPDRFSGSKSGTSASLTISGAQSEDEADYYCSARDSSGSHVIFGAGTKVTVLG

SEQ ID NO: 2073 - protein, 250 aa, Homo sapiens
EVQLVQSGAEVKKPGSSVKVSCKASGGTFSSYALSWVRQAPGQGLEWMGIFIPIFGTEYYAERFQGRVTITADESTNTAYLDLSSLRSEDTAVYYCARVDYTDYEMGAFDLWGQGTLVTVSSGGGGSGGGGSGGGGSAQAVLTQPSSVSGAPGQRVTISCTGSSSNIGAGYDVHWYQQLPGKGPKVLMYDNNNRPSGVPDRFSGSKSGASASLAITGLQAEDEADYYCQSYDSSLDGYVFGTGTKVTVLG

SEQ ID NO: 2074 - protein, 250 aa, Homo sapiens
EVQLVQSGAEVKKPGASVKVSCKASGYTSTIYHIHWVRQAPGQGLEWMGIINPSGGSTSYAQKFQGRVTMTRDTSTSTVYMELSSLRSEDTAVYYCARDRIAAAGGDAFDIWGRGTMVTVSSGGGGSGGGGSGGGGSAQAVLTQPSSVSGAPGQRVTISCTGSSSNIGDGYDVHWYQQLPGTAPKLLIYGNTNRPSGVPDRFSGSKSDTSASLAITGLQVEDEADYFCHSYDSSMSGWIFGGGTKVTVLG

SEQ ID NO: 2075 - protein, 246 aa, Homo sapiens
EVQLVETGGGLVQPGGSLTLSCAASGFTFSYYAMSWVRQAPGKGLEWVSTTSYSGENTFYADSVKGRFTISRDNSINTLYLQMSRLTAEDTAVYYCAKDLYKNGYALFDSWGRGTMVTVSSGGGGSGGGGSGGGGSALDVVMTQSPSSLSASVGDGVTITCRASQSISNHLSWYQQKPGKAPNVLIYAASSLQSGVPSRFSGSGSGTDFTLTISSLQPEDSAIYYCQQSYDTPPTFGQGTRLEIKR

SEQ ID NO: 2076 - protein, 247 aa, Homo sapiens
EVQLVQSGAEVKKPGASVKVSCRASGYTFASYFLHWVRQAPGQGLEWMGIINPNGGITRYAQKFQGRVTMTRDTSTSTVYMELSSLRSEDTAVYYCARDEYSSLYMDVWGRGTLVTVSSGGGGSGGGGSGGGGSAQAVLTQPSSVSGAPGQRVTISCAGSSSNIGAGYDVQWYQQLPGTAPKLLIHNNNNRPSGVPDRFSGAKSGSSASLAITGLQAEDEADYYCQSFDSSLSRWVFGGGTKLTVLG

SEQ ID NO: 2077 - protein, 246 aa, Homo sapiens
QVQLQESGGGVVQPGRSLRISCTASGFTFKDYGMHWVRQAPGKGLEWVALIYYDGSKEYYADSVQGRFTISRDNSRNALYLQMNSLRAEDTAVYYCVSFGAGRLYDDYWGRGTMVTVSSGGGGSGGGGSGGGGSAQSALTQPASVSGSPGQSITLSCTGTSSDVGGYNYVSWYQQHPGKAPELLIYDVTNRPSGVSNRFSGSKSGNTASLTISGLQAEDEADYYCNSYTGSNTWVFGGGTKLTVLG

SEQ ID NO: 2078 - protein, 249 aa, Homo sapiens
QVQLVQSGAEVKKPGASVRVSCKASGYTFTNYGISWVRQAPGQGLEWMGWISNNNGKTYYAQKVQGRVTMTTDTSTSTDYMELRGLRSDDTAIYYCARDNGGGTIGFDYWGQGTLVTVSSGGGGSGGGGSGGGGSAQSVLTQPPSVSGAPGQRVTISCTGSSSNIGADYDVHWYQLLPGTAPKLLIYGNTNRPSGVPDRFSGSKSGTSASLTIAGLQAEDEADYYCQSYDSSLSGSVVFGGGTKLTVLG

SEQ ID NO: 2079 - protein, 246 aa, Homo sapiens
EVQLVQSGAGVKKPGASVKVSCQASGYTFTGFYMHWVRQAPGQGLEWMGWINPNSGATKYSQKFQGRVTMTRDTSINTAYMELTRLNSDDTAFYFCARDQGIETANDYWGRGTLVTVSSGGGGSGGGGSGGGGSAQSALTQPRSVSGSPGQSVAISCTGTSSDVGGYNYVSWYQQHPGKAPKLMIYGVSNRPSGVSNRFSGSKSGNTASLTISGLQAEDEADYYCNSWTSSSTFVFGTGTKLTVLG

SEQ ID NO: 2080 - protein, 256 aa, Homo sapiens
QVQLVQSGAEVKKPGASVKVSCKASGYPFTHYGVNWVRQAPGRGLEWMGWISAYNGKTHYAQKFQGRVTMTTDTSTTTVYMDVRGLTTDDTAVYYCARDILPDYDFWNPNEDASSLDTWGKGTLVTVSSGGGGSGGGGSGGGGSAQSALTQPASVSGSPGQSITISCSGTSSDVGTYNYVSWYQQHPGKAPKLMIYDVNNRPSGVSHRFSGSKSGNTASLTISGLQAEDEADYYCNSYTTISTYVFGTGTKLTVLG

SEQ ID NO: 2081 - protein, 262 aa, Homo sapiens
QVQLVQSGGGLVKPGGSLRLSCAASGFIYNIYSMNWVRQAPGKGLEWVSSISSSSSYIYYADSVKGRFTISRDNAKNSLYLQMNSLRAEDTAVYYCARDFQMVRGVFIANPPIYNYYGMDVWGKGTTVTVSSGGGGSGGGGSGGGGSALEIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGGGTKVEIKR

SEQ ID NO: 2082 - protein, 254 aa, Homo sapiens
QVQLVQSGADVKKPGASVRVSCKASGYTYTSHYIHWVRQAPGRGLEWMGVINPSGGATNYAQKFQGRVTMTRDTSSTTVYMELSSLRFEDTAIYYCVRDADEGLVEAETTNWFDSWGQGTMVTVSSGGGGSGGGGSGGGGSAQSVLTQPPSVSGAPGQRVTISCTGGSSNIGASYDVNWYQQLPGTAPKLLISGNTNRPSGVPDRFSGSNSGTSASLAITGLQAEDEADYYCQSYDNSLSGWVFGGGTKVTVLG

SEQ ID NO: 2083 - protein, 258 aa, Homo sapiens
QVQLQESGPGLVKPSQTLSLTCDISGDSVSSNSAAWNWIRQSPSRGLEWLGRTYYRSKWYTDYAESVKSRLAINPDTSKNQFSLQLSSVTPEDTAVYYCARATKSYDILTRMYYYHMDVWGQGTLVTVSSGGGGSGGGGSGGGGSAQAVLTQPSSASGTPGQRVTISCSGSSSNIGSNTVNWYQQLPGTAPKLLIYGNNQRPSGVPDRFSGSKSGTSASLAISGLQSEDEADYYCAAWDDSLSVPWVFGTGTKLTVLG

SEQ ID NO: 2084 - protein, 242 aa, Homo sapiens
EVQLVQSGAEVKKPGASVKVSCKASGYTFGSYWMHWVRQAPGQGLEWMGTINPSSGSTSYTQKFQGRVTMTRDTSTSTVYMELSRLKSEDTAVYYCARDRTRMDVWGQGTLVTVSSGGGGSGGGGSGGGGSALSSELTQDPAVSVALGQTVRITCQGDSLRTYYANWYQQKPGQAPVVVIYGKNNRPSGIPDRFSGSSSGYTASLTITGAQAEDEADYYCNSGDRSGNHYVFGTGTKLTVLG

SEQ ID NO: 2085 - protein, 249 aa, Homo sapiens
QVQLVQSGAELKQPGTSVKVSCKASGYSFSSYGVTWVRQAPGQGLEWMGWVSGNRGNTQYAQKFQDRVRMTTDTSTSTAYMELRSLRPDDTVVYFCARVGIKAAAVDNFEYWGRGTTVTVSSGGGGSGGGGSGGGGSAQSVLTQPPSASGTPGQRVTITCSGSSSNIGDYYVNWYQQVSGTTPKLIIYRDDQRPSGVPDRFSGSKSGASASLAISGLRSEDEANYFCAAWDDSLREFAFGTGTKVTVLG

SEQ ID NO: 2086 - protein, 248 aa, Homo sapiens
EVQLVQSGPEVKTPGASVRVSCKPSGYTVANHGINWVRQAPGQGLEWMGWVSLYNGNAKSAQKFQDRVTMTADTSTATAYLDLKSLRYDDTAVYYCVRDEIYNDAFDYWGKGTMVTVSSGGGGSGGGGSGGGGSAQSVVTQPPSVSGAPGQRVTISCTGSSSNIGAGFDVQWYQHLPGTAPKLLIYGDNNRPSGVPDRFSASKSGTSASLAITGLHVDDEADYYCQSYDSGLGGSYVFGTGTKVTVLG

SEQ ID NO: 2087 - protein, 255 aa, Homo sapiens
EVQLVQSGPEVKKPGASVRVSCKASGYTFTDYYMHWVRQAPGQGLEWMGIINPSAGYTSYAQKFQGRVIMTRDTSTSTLYMDLNSLRSEDTAMYYCARDGDISDSPINNQNYAMDIWGRGTMVTVSSGGGGSGGGGSGGGGSAQSVLTQPSSVSGAPGQRVTISCTGSSSNIGAGYNVHWYHQLPGTAPQLLIYGNINRPSGVPDRFSGSKSGTSASLTITGLQAEDEADYYCQSYDTSLSGWVFGGGTKLTVLG

SEQ ID NO: 2088 - protein, 248 aa, Homo sapiens
EVQLVQSGAEVKKPGESLRISCKGSGYSFTSYWISWVRQMPGKGLEWMGRIDPSDSYTNYSPSFQGHVTISADRSISTAYLQWSSLKASDTAIYYCARRGGTSENYSGMDVWGQGTLVTVSSGGGGSGGGGSGGGGSALSSELTQDPAVSVALGQTVRITCQGDSLRTYYANWYQQKPGQAPVVVIYGKNNRPSGIPDRFSGSSSGYTASLTITGAQAEDEADYYCNSGDRSGNHYVFGTGTKLTVLG

SEQ ID NO: 2089 - protein, 245 aa, Homo sapiens
QVQLVQSGAEAKKPGASLQISCKASGYNFISYYIHWVRQAPGQGLEWMGVIYPNGGATFYAQKFQSRVAMSRDTSTHTVYMDLRSLRSDDTAVYYCVRDYPHNAFDIWGRGTTVTVSSGGGGSGGGGSGGGGSAQSALTQPASVSGSPGQSITISCTGTSSDVGGYNYVSWYQHHPGKAPKLMIYEVNNRPSGISNRFSGSKSGNTASLTISGLQAEDEADYYCSSYTSSTTLVFGGGTKVTVLG

SEQ ID NO: 2090 - protein, 258 aa, Homo sapiens
QVQLVQSGAEVKKPGASVKLSCKASAYTFYSYYIHWVRQAPGQGLEWMGIINPSGGSTTYAQKFQGRVTMTRDTSTSTVYMQLSSLRSEDTAVYYCARDVRSDRFWSGGYFHYSGMDVWGQGTLVTVSSGGGGSGGGGSGGGGSAQSALTQPASVSGSPGQSVTISCAGTSSDIGGHDFVSWYQQHPGKAPKLMIYDVSKRPSGISHRFAASKSGNTASLTISGLQAEDEADYYCSSYTTISSTFRVFGGGTKVTVLG

SEQ ID NO: 2091 - protein, 248 aa, Homo sapiens
EVQLVQAGAEVKKPGASVKVSCKASGYTFTDYYMHWVRQAPGQGLEWMGIINPSGGSTSYAQKFQGRVTMTRDTSTSTVYMELSSLRSEDTAVYFCARSTLEVGATDFDYWGQGTMVTVSSGGGGSGGGGSGGGGSALPVLTQPPSASGTPGQRVTISCSGSTSNIGINYVYWYQQLPGTAPKLLIYRNNQRPSGVPDRFSGSKSGTSASLAISGLRSEDEAEYYCAAWDDSLSGYVFGIGTKVTVLG

SEQ ID NO: 2092 - protein, 247 aa, Homo sapiens
EVQLVETGGGLVQSGGSLRLSCEASGFSFSNYWMGWVRQAPGKGLEWVANIKKDGTDTRYVDSVKGRFTISRDNVKNSLYLQMYSLRVEDTANYYCARSDDWGAYHIWGRGTMVTVSSGGGGSGGGGSGGGGSAQAVLTQPSSVSGAPGQRVTISCTGSSSNIGAGYDVHWYQQLPGTAPKLLIYGNSNRPSGVPDRFSGSKSGTSASLAITGLQAEDEADYYCQSYDSSLSGSVVFGGGTKVTVLG

SEQ ID NO: 2093 - protein, 250 aa, Homo sapiens
QVQLVQSGTEVKKPGASMKVSCKSSGYTFTNYYIHWVRQAPGQGLEWMGIIDPTSGRTVYAQRFKGRVTMTRDTSTSTVYMELTSLKSGDTAVYYCARERGGRDGDYALDFWGRGTMVTVSSGGGGSGGGGSGGGGSAQAVLTQPSSVSGAPGQRVTISCTGSSSNIGDGYDVHWYQQLPGTAPKLLIYGNSHRPSGVPDRFSGSKSDTSASLAITGLQVEDEADYFCHSYDSSVSGWIFGGGTKVTVLG

SEQ ID NO: 2094 - protein, 248 aa, Homo sapiens
EVQLVQSGAEVKKPGASVKVSCKASGYTFTNYYMHWVRQAPGQGLEWMGIINPNGGRVSYAQKFQDRVTMTRDTSTSTVYMDLSSLRSEDTAVYYCARELVGAPGGFDPWGRGTLVTVSSGGGGSGGGGSGGGGSAQAVLTQPSSVSGAPGQRVTISCTGSSSNIGTGYDVHWYQHLPGTAPKLLIYGDTNRPSGVPDRFSGSKSDTSASLAITGLQAEDEAEYYCQSYDSSRRGYVFGTGTKVTVLG

SEQ ID NO: 2095 - protein, 250 aa, Homo sapiens
EVQLVQSGAEVKKPGSSVKVSCKASGGTFSSYALSWVRQAPGQGLEWMGIFIPIFGTEYYAERFQGRVTITADESTNTAYLDLSSLRSEDTVVYYCARVDYTDYEMGAFDLWGQGTLVTVSSGGGGSGGGGSGGGGSAQAVLTQPSSVSGAPGQRVTISCTGSSSNIGAGYDVHWYQQLPGKGPKVLMYDNNNRPSGVPDRFSGSKSGASASLAITGLQAEDEADYYCQSYDSSLDGYVFGTGTKVTVLG

SEQ ID NO: 2096 - protein, 249 aa, Homo sapiens
QLQLQESGGGLVQPGGSLRLSCAASEFIFSDHYVDWVRQAPGKGLEWVARSRDKAGRYTTEYAASVKGRFIVSRDDARDSVYLQMNSLKVEDTAVYYCARSVAGRGNFDYWGQGTMVTVSSGGGGSGGGGSGGGGSALSSELTQDPSASGTPGQRVTISCSGSGSNIGSNYVYWYQQLPGTAPKLLIYRSTQRPSGVPDRFSASKSGTSASLAISGLRSDDEADYYCATWDDSLSGYVFGPGTKVTVLG

SEQ ID NO: 2097 - protein, 250 aa, Homo sapiens
EVQLVQSGTEVKKPGASLKVSCKSSGYTFTNYYIHWVRQAPGQGLEWMGIIDPTSGRTVYAQRFKGRVTMTRDTSTSTVYMELTSLKSEDTAVYYCARERGGRDGDYALDFWGRGTMVTVSSGGGGSGGGGSGGGGSAQSVVTQPPSVSGAPGQRVTISCTGSSSNIGDGYDVHWYQQLPGTAPKLLIYGNSHRPSGVPDRFSGSKSDTSASLAITGLQVEDEADYFCHSYDSSVSGWIFGGGTKLTVLG

SEQ ID NO: 2098 - protein, 253 aa, Homo sapiens
EVQLVQSGAAVKKPGASVKVSCKASGYTFTTYYIHWVRQAPGQGLEWMGIINPVNGNTIYAQKFQGRVTMTRDTSTGTVNMELSSLRSEDTAVFYCVREGGGDAYDVAPYYFDYWGQGTLVTVSSGGGGSGGGGSGGGGSAQAVLTQQSSVSGAPGQRVTISCTGSSSNIGDGYDVHWYQQLPGTAPKLLIYGNSHRPSGVPDRFSGSKSDTSASLAITGLQVEDEADYFCHSYDSSVSDWIFGGGTKLTVLG

SEQ ID NO: 2099 - protein, 242 aa, Homo sapiens
QVQLVQSGAEVKKPGASVKVSCKASGYSFTDYFIHWVRQAPGQGLEWMGWINPKNGGTYFAQDFQGRVTMTGDTSIATAFMELSGLKSDDTAIYYCATDPFDYWGRGTLVTVSSGGGGSGGGGSGGGGSALSYELTQPPSVSGTPGQRVTISCSGSNSNIGINAVNWYKQLPGTAPKLLIYNNNQRPSWVRDRFSGSKDGTSVSLAISGLQSEDEADYYCASWDDSLNAYVFGGGTKVTVLG

SEQ ID NO: 2100 - protein, 252 aa, Homo sapiens
QVQLVQSGAEVKKPGASVRVSCKASGYIFRNHDVNWVRQAPGRGLEWVGWMNPTSGNTGIGQKFQGRVKMTRDNSKDTAYMELSSLTSDDTATYFCARALLGLPSDFSYYVDVWGKGTLVTVSSGGGGSGGGGSGGGGSAHVILTQPPSVSGAPGQRVTISCTGGSSNLGAGSDVHWYQQLPRTAPKLLIYANTNRPSGVPDRFSGSKSGTSASLAITGLQAEDEADYYCQSYDKSLSGVVFGGGTKLTVLG

SEQ ID NO: 2101 - protein, 253 aa, Homo sapiens
EVQLVQSGAAVKKPGASVNVSCKASGYTFTTYYIHWVRQAPGQGLEWMGIINPINGNTIYAQKFQGRVTMTRDTSTGTVNMELSSLRSEDTAVFYCAREGEGDGYNVAPYYFDYWGQGTLVTVSSGGGGSGGGGSGGGGSAQSVVTQPPSVSGAPGQRVTISCTGSSSNIGDGYDVHWYQQLPGTAPKLLIYGNSHRPSGVPDRFSGSKSDTSASLAITGLQVEDEADYFCHSYDSSVSGWIFGGGTKVTVLG

SEQ ID NO: 2102 - protein, 243 aa, Homo sapiens
EVQLVQSGGGLVQPGGSLRLSCAASGFTFSSYSMNWVRQAPGKGLEWVSYISSSSSTIYYADSVKGRFTISRDNAKNSLYLQMNSLRAEDTAVYYCARTDYGGFDYWGKGTLVTVSSGGGGSGGGGSGGGGSALSSELTQDPAVSVALGQTVRITCQGDSLRTYYANWYQQKPGQAPVVVIYGKNNRPSGIPDRFSGSSSGYTASLTITGAQAEDEADYYCNSGDRSGNHYVFGTGTQLTVLS

SEQ ID NO: 2103 - protein, 247 aa, Homo sapiens
EVQLVQSGADVKKPGESLKISCEGSGYTFANYWITWVRQMPGKGLEWMGRIDPSDSYTNYNPSFQGHVTMSVDKSINTAYLQWSSLKASDTAKYYCARGGVGDSRGVFDPWGKGTLVTVSSGGGGSGGGGSGGGGSALSSELTQDPAVSVALGQTVRITCQGDSLRTYYANWYQQKPGQAPVVVIYGKNNRPSGIPDRFSGSSSGYTASLTITGAQAEDEADYYCNSGDRSGNHYVFGTGTKLTVLG

SEQ ID NO: 2104 - protein, 237 aa, Homo sapiens
QVQLVQSGGGLVQPGGSLRLSCAASGFTFSSYEMNWVRQAPGKGLEWVSYISSSGSTIYYADSVKGRFTISRDNAKNSLYLQMNSLRAEDTAVYYCARDTTDYWGQGTTVTVSSGGGGSGGGGSGGGGSDIVMTQSPSTLSASVGDRVTITCRASQGISSWLAWYQQKPGRAPKVLIYKASTLESGVPSRFSGSGSGTDFTLTISSLQPEDFATYYCQQSYSTPWTFGQGTKLEIKR

SEQ ID NO: 2105 - protein, 240 aa, Homo sapiens
QVQLVQSGGGLVQPGGSLRLSCAASGFTFSSYEMNWVRQAPGKGLEWVSYISSSGSTIYYADSVKGRFTISRDNAKNSLYLQMNSLRAEDTAVYYCARDTTDYWGQGTTVTVSSGGGGSGGGGSGGGGSQSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLG

SEQ ID NO: 2106 - protein, 242 aa, Homo sapiens
QVQLQESGAEVKKPGASVKVSCKASGYTFTGYYMHWVRQAPGQGLEWMGWINPNSGGTNYAQKFQGRVTMTRDTSISTAYMELSRLRSDDTAVYYCARESLTGDAFDIWGRSTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 2107 - protein, 243 aa, Homo sapiens
QVQLQESGAEVKKPGASVKVSCKASGYTFTGYYMHWVRQAPGQGLEWMGWINPNSGGTNYAQKFQGRVTMTRDTSISTAYMELSRLRSDDTAVYYCARSPLHFSDAFDIWGRSTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 2108 - protein, 240 aa, Homo sapiens
QVQLVQSGGGLVQPGGSLRLSCAASGFTFSSYEMNWVRQAPGKGLEWVSYISSSGSTIYYADSVKGRFTISRDNAKNSLYLQMNSLRAEDTAVYYCARDTTDYWGQGTLVTVSSGGGGSGGGGSGGGGSQSVLTQPPSASGTPGQRVTISCSGGSSNIGSNTVNWYQRLPGAAPQLLIYNNDQRPSGIPDRFSGSKSGTSGSLVISGLQSEDEADYYCASWDDSLNGRVFGGGTKLTVLG

SEQ ID NO: 2109 - protein, 243 aa, Homo sapiens
EVQLVESGAEVKKPGASVKVSCKASGYTFTGYYMHWVRQAPGQGLEWMGWINPNSGGTNYAQKFQGRVTMTRDTSISTAYMELSRLRSDDTAVYYCAREVGGAFDIWGRSTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 2110 - protein, 237 aa, Homo sapiens
QVQLVQSGGGLVQPGGSLRLSCAASGFTFSSYEMNWVRQAPGKGLEWVSYISSSGSTIYYADSVKGRFTISRDNAKNSLYLQMNSLRAEDTAVYYCARDTTDYWGQGTLVTVSSGGGGSGGGGSGGGGSDIVMTQSPSTLSASVGDRVTITCRASQGISSWLAWYQQKPGRAPKVLIYKASTLESGVPSRFSGSGSGTDFTLTISSLQPEDFATYYCQQSYGTPWTFGQGTKLEIKR

SEQ ID NO: 2111 - protein, 237 aa, Homo sapiens
QVQLVQSGGGLVQPGGSLRLSCAASGFTFSSYEMNWVRQAPGKGLEWVSYISSSGSTIYYADSVKGRFTISRDNAKNSLYLQMNSLRAEDTAVYYCARDTTDYWGQGTLVTVSSGGGGSGGGGSGGGGSDIVMTQSPYTLSASVGDRVTITCRASQGISSWLAWYQQKPGRAPKVLIYKASTLESGVPSRFSGSGSGTDFTLTISSLQPEDFATYYCQQSYSTPWTFGQGTKLEIKR

SEQ ID NO: 2112 - protein, 237 aa, Homo sapiens
QVQLVQSGGGLVQPGGSLRLSCAASGFTFSSYEMNWVRQAPGKGLEWVSYISSSGSTIYYADSVKGRFTISRDNAKNSLYLQMNSLRAEDTAVYYCARDTTDYWGQGTRVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 2113 - protein, 240 aa, Homo sapiens
QVQLVQSGGGLVQPGGSLRLSCAASGFTFSSYEMNWVRQAPGKGLEWVSYISSSGSTIYYADSVKGRFTISRDNAKNSLYLQMNSLRAEDTAVYYCARDTTDYWGQGTTVTVSSGGGGSGGGGSGGGGSQSVLTQPPSASGTPGQRVTISCSGSSSNIGSNTVNWYQRLPGAAPQLLIYNNDQRPSGIPDRFSGSKSSTSGSLVISGLQSEDEADYYCASWDDSLNGRVFGGGTKLTVLG

SEQ ID NO: 2114 - protein, 237 aa, Homo sapiens
QVQLVQSGGGLVQPGGSLRLSCAASGFTFSSYEMNWVRQAPGKGLEWVSYISSSGSTIYYADSVKGRFTISRDNAKNSLYLQMNSLRAEDTAVYYCARDTTDYWGQGTMVTVSSGGGGSGGGGSGGGGSDIVMTQSPSTLSASVGDRVTITCRASQGISSWLAWYQQKPGRAPKVLIYKASTLESGVPSRFSGSGSGTDFTLTISSLQPEDFATYYCQQSYSTPWTFGQGTKLEIKR

SEQ ID NO: 2115 - protein, 237 aa, Homo sapiens
QVQLVQSGGGLVQPGGSLRLSCAASGFTFSSYEMNWVRQAPGKGLEWVSYISSSGSTIYYADSVKGRFTISRDNAKNSLYLQMNSLRAEDTAVYYCARDTTDYWGQGTLVTVSSGGGGSGGGGSGGGGSDIVMTQSPSTLSASVGDRVTITCRASQGISSWLAWYQQKPGRAPKVLIYKASTLESGVPSRFSGSGSGTDFTLTISSLRPEDFATYYCQQSYSTPWTFGQGTKLEIKR

SEQ ID NO: 2116 - protein, 245 aa, Homo sapiens
EVQLVESGAEVKKPGASVKVSCKASGYTFTGYYMHWVRQAPGQGLEWMGWINPNSGGTNYAQKFQGRVTMTRDTSISTAYMELSRLRSDDTAVYYCARESLTGDAFDIWGRSTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 2117 - protein, 240 aa, Homo sapiens
QVQLVQSGGGLVQPGGSLRLSCAASGFTFSSYEMNWVRQAPGKGLEWVSYISSSGSTIYYADSVKGRFTISRDNAKNSLYLQMNSLRAEDTAVYYCARDTTDYWGQGTMVTVFSGGGGSGGGGSGGGGSQSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLG

SEQ ID NO: 2118 - protein, 237 aa, Homo sapiens
QVQLVQSGGGLVQPGGSLRLSCAASGFTFSSYEMNWVRQAPGKGLEWVSYISSSGSTIYYADSVKGRFTISRDNAKNSLYLQMNSLRAEDTAVYYCARDTTDYWGQGTLVTVSSGGGGSGGGGSGGGGSDIVMTQSPSTLSASVGDRVTITCRASQGISSWLVWYQQKPGRAPKVLIYKASTLESGVPSRFSGSGSGTDFTLTISSLQPEDFATYYCQQSYSTPWTFGQGTKLEIKR

SEQ ID NO: 2119 - protein, 256 aa, Homo sapiens
QVQLVQSGGDFVQPGGPLRLSCAASGFTFSSYDMNWVRQAPGKGLEWVSTISSGGGSTFYADSVKGRFVISRDNSKNTLYLQLNSLRADDTAVYYCVKGAHYYDRSPSHLKSYWYFDLWGKGTLVTVSSGGGGSGGGGSGGGGSAQSVLTQPPSASGTPGQRVTISCSGSSSNIGSNPLNWYQQLPGTAPKLLIYTNDQRPSGVPDRFSGSKSGTSASLAISGLQSEDAADYYCAAWDDSLGTWVFGGGTKLTVLG

SEQ ID NO: 2120 - protein, 249 aa, Homo sapiens
QVQLVQSGAELKQPGTSVKVSCKASGYSFSSYGVTWVRQAPGQGLEWMGWVSGNRGNTQYAQKFQDRVRMTTDTSTSTAYMELRSLRPDDTAVYFCARVGIKAAAVDNFEYWGRGTTVTVSSGGGGSGGGGSGGGGSAQSVLTQPPSASGTPGQRVTITCSASSSNIGDYYVNWYQQVSGTTPKLIIYRDDQRPSGVPDRFSGSKSGASASLAISGLRSEDEANYFCAAWDDSLREFAFGTGTKVTVLG

SEQ ID NO: 2121 - protein, 248 aa, Homo sapiens
EVQLVQSGAEVKKPGSSVKVSCKSSGGTFSSYALSWVRQAPGQGLEWMVGIIPIFGTTNYAQKFQGRVTITADKSTSTAYMELISLRSEDTAVYYCTTLGRNYTSSWSLDYWGRGTMVTVSSGGGGSGGGGSGGGGSALSSELTQDPAVSVALGQTVRITCQGDSLRSYYASWYQQKPRQAPVLVIYGKNDRPSGIPDRFSGSNSGNTASLTITGAQAEDEADYYCNSRDTSGNHLVFGTGTKLTVLG

SEQ ID NO: 2122 - protein, 249 aa, Homo sapiens
QVQLVQSGAELKQPGTSVKVSCKASGYSFSSYGVTWVRQAPGQGLEWMGWVSGNRGNTQYAQKFQDRVRMTTDTSTSTAYMELRSLRPDDTAVYFCARVGIKAAAVDNFEYWGRGTTVTVSSGGGGSGGGGSGGGGSAQSVLTQPPSASGTPGQRVTITCSGSSSNIGDYYVNWYQQVSGTTPKLIIYRDDQRPSGVPDRFSGSKSGASASLAISGLRSEDEANYFCAAWDDSLREFAFGSGTKVTVLG

SEQ ID NO: 2123 - protein, 255 aa, Homo sapiens
QVQLQESGGGVVQSGTSLRLSCAASGFMFRSYEMHWVRQAPGKGLEWVALISYDGSNENYADSVKGRFTVSRDNSENTLYVQMNSLRPEDTAVYYCARGGRYGYYYDGTGYVDAFDIWGRGTLVTVSSGGGGSGGGGSGGGGSAQPVLTQPPSASGTPGQRVTISCSGSSSNIGVNTVDWYLQLPGTAPKLLIFNNDLRPSGVPARFSGSKSGTSASLAISGLQSEDEADYYCATWDDSLNGPVFGGGTKLTVLG

SEQ ID NO: 2124 - protein, 247 aa, Homo sapiens
QVQLVQSGAEVKKPGASVRVSCKSSGYTFTNYGISWVRQAPGQGLEWMGWISNNNGKTYYAQKVQGRVTMTTDTSTSTDYMELRGLRSDDTAIYYCARDNGGGTIGFDYWGRGTLVTVSSGGGGSGGGGSGGGGSAQAVLTQPSSVSGAPGQRVTMSCTGSSSIIGAGYDVHWYQQLPGTAPKLLIYDNTNRPSGVPDRFSGSRSGTSASLAITGLQDEDEADYFSQSYGITLSAVFGTGTKVAVLG

SEQ ID NO: 2125 - protein, 251 aa, Homo sapiens
QVQLVQSGAEVTKPGASVKVSCKTSGYSFSTYKITWVRQAPGQGLEWLGWISPNSGGTNFAQILQGRVAMTTDTSTSTAYLELRSLRSDDTAVYYCARVRQQIADPPRSFFDPWGKGTMVTVSSGGGGSGGGGSGGGGSAQPVLTQPPSASGTPGQRVTISCSGSSSNIGSNTVNWYQQLPGTAPKLLMYSNNQRPSGVPDRFSGSKSGTSASLAITGLQAEDEADYYCQSFDSSLNVRIFGGGTKLTVLG

SEQ ID NO: 2126 - protein, 247 aa, Homo sapiens
QVQLVQSGAEVKKPGASVRVSCKSSGYTFTNYGISWVRQAPGQGLEWMGWISNNNGKTYYAQKVQGRVTMTTDTSTSTDYMELRGLRSDDTAIYYCARDNGGGTIGFDYWGRGTLVTVSSGGGGSGGGGSGGGGSAQAVLTHPSSVSGAPGQRVTMSCTGSSSNIGAGYDVHWYQQLPGTAPKLLIYDNTNRPSGVPDRFSGSRSGTSASLAITGLQAEDEADYFCQSYDITLSAVFGTGTKVTVLG

SEQ ID NO: 2127 - protein, 247 aa, Homo sapiens
QVQLVQSGAEVKKPGASVRVSCKSSGYTFTNYGISWVRQAPGQGLEWMGWISNNNGKTYYAQKVQGRVTMTTDTSTSTDYMELRGLRSDDTAIYYCARDNGGGTIGFDYWGRGTLVTVSSGGGGSGGGGSGGGGSAQAVLTQQSSVSGAPGQRVTMSCTGSSSNIGAGYDVHWYQQLPGTAPKLLIYDNTNRPSGVPDRFSGSRSGTSASLAITGLQAEDEADYFCQSYDITLSAVFGTGTKVTVLG

SEQ ID NO: 2128 - protein, 251 aa, Homo sapiens
QVQLVQSGAEVTKPGASVKVSCKTSGYSFSTYKITWVRQAPGQGLEWLGWISPNSGGTNFAQILQGRVAMTTDTSTSTAYLELRSLRSDDTAVYYCARVRQQIADPPRSFFDPWGKGTMVTVSSGGGGSGGGGSGGGGSAQSVLTQPPSASGTPGQRVTISCSGSSSNIGSNSVNWYQQLSGTAPKLLMYSNNQRPSGVPDRFSGSKSGASASLAITGLQAEDEADYYCQSFDSSLNVRIFGGGTKLTVLG

SEQ ID NO: 2129 - protein, 16 aa, Homo sapiens
DRYDILTGYYYYGMDV

SEQ ID NO: 2130 - protein, 13 aa, Homo sapiens
HDDDVLTGYYFES

SEQ ID NO: 2131 - protein, 20 aa, Homo sapiens
AATTSQKHNKYAYYFYGMDV

SEQ ID NO: 2132 - protein, 23 aa, Homo sapiens
VQMDSEYYDLLTGINVGPYYFDY

SEQ ID NO: 2133 - protein, 14 aa, Homo sapiens
SRDLLLFPHYGMDV

SEQ ID NO: 2134 - protein, 15 aa, Homo sapiens
APYDLLTHYFHYFDY

SEQ ID NO: 2135 - protein, 17 aa, Homo sapiens
DGYYDILTGYSYYGMDV

SEQ ID NO: 2136 - protein, 12 aa, Homo sapiens
GYDSSAFRAFDI

SEQ ID NO: 2137 - protein, 16 aa, Homo sapiens
PFYDTLTSYVFQYFDH

SEQ ID NO: 2138 - protein, 16 aa, Homo sapiens
PFYDILTRYVFQYFDH

SEQ ID NO: 2139 - protein, 16 aa, Homo sapiens
PFYDILTSYVFQYFDH

SEQ ID NO: 2140 - protein, 16 aa, Homo sapiens
PFYDTLTGYVFQVWVA

SEQ ID NO: 2141 - protein, 16 aa, Homo sapiens
PFYDTLTGYVFQYFDH

SEQ ID NO: 2142 - protein, 16 aa, Homo sapiens
PFYDTLTRYVFQVWVA

SEQ ID NO: 2143 - protein, 16 aa, Homo sapiens
PFYDTLTSYVFQVWVA

SEQ ID NO: 2144 - protein, 16 aa, Homo sapiens
PFYDTLTRYVFQYFDH

SEQ ID NO: 2145 - protein, 16 aa, Homo sapiens
PFYDTLTSYVLGYYLS

SEQ ID NO: 2146 - protein, 14 aa, Homo sapiens
SRDLLLFPHHGLDS

SEQ ID NO: 2147 - protein, 14 aa, Homo sapiens
SRDLLLFPHHSFDL

SEQ ID NO: 2148 - protein, 14 aa, Homo sapiens
SRDLLLFPLAPLYP

SEQ ID NO: 2149 - protein, 14 aa, Homo sapiens
SRDLLLFPHHALSP

SEQ ID NO: 2150 - protein, 14 aa, Homo sapiens
SRYLLLFPHHSFDL

SEQ ID NO: 2151 - protein, 14 aa, Homo sapiens
SRDLLLFPHHGLDV

SEQ ID NO: 2152 - protein, 14 aa, Homo sapiens
SRDLLLFPHHSLDL

SEQ ID NO: 2153 - protein, 16 aa, Homo sapiens
ATYDPLTGYSFDGFDI

SEQ ID NO: 2154 - protein, 18 aa, Homo sapiens
DGSYDILTGYYIDNYMDV

SEQ ID NO: 2155 - protein, 19 aa, Homo sapiens
FNPTYDILTGYYIGGYFQH

SEQ ID NO: 2156 - protein, 17 aa, Homo sapiens
GGDYDILTGLYYYGMDV

SEQ ID NO: 2157 - protein, 16 aa, Homo sapiens
ATYDPLTGYSFDGLDI

SEQ ID NO: 2158 - protein, 20 aa, Homo sapiens
EGGNYDILTGYYIGNGAFDI

SEQ ID NO: 2159 - protein, 22 aa, Homo sapiens
SSPPKWYDALTGHSSYHSAMDV

SEQ ID NO: 2160 - protein, 15 aa, Homo sapiens
DGIDILLVPAALMDV

SEQ ID NO: 2161 - protein, 10 aa, Homo sapiens
GMGDHYGMDV

SEQ ID NO: 2162 - protein, 19 aa, Homo sapiens
GRWDYDLLTGEHLGYYFDY

SEQ ID NO: 2163 - protein, 16 aa, Homo sapiens
GYHDPLTSYNYNWFDP

SEQ ID NO: 2164 - protein, 15 aa, Homo sapiens
QDNDPLTGYKLGFDY

SEQ ID NO: 2165 - protein, 22 aa, Homo sapiens
SSPPKWYDALTGDSSYHSAMDV

SEQ ID NO: 2166 - protein, 16 aa, Homo sapiens
SHYDILTGLNYWYFDL

SEQ ID NO: 2167 - protein, 19 aa, Homo sapiens
HVRDYDILTGYYRGHYFDY

SEQ ID NO: 2168 - protein, 18 aa, Homo sapiens
DEGRDLLTGYYWPNFFDS

SEQ ID NO: 2169 - protein, 22 aa, Homo sapiens
SSPPRWYDALTGDSSYHSAMDV

SEQ ID NO: 2170 - protein, 19 aa, Homo sapiens
GGEYDILTGYYFGLGVYDY

SEQ ID NO: 2171 - protein, 19 aa, Homo sapiens
EGSYDILTGYYVGVGRMDV

SEQ ID NO: 2172 - protein, 21 aa, Homo sapiens
DREAYYDILTGYYLYYYYMDV

SEQ ID NO: 2173 - protein, 16 aa, Homo sapiens
TDYDILTGYPMGYFDP

SEQ ID NO: 2174 - protein, 16 aa, Homo sapiens
ELGLSIVGATTGALDM

SEQ ID NO: 2175 - protein, 8 aa, Homo sapiens
DQGRYLDL

SEQ ID NO: 2176 - protein, 24 aa, Homo sapiens
DRGAPNYDILTGYYAPAQGVAFDI

SEQ ID NO: 2177 - protein, 15 aa, Homo sapiens
VYYDILTGYNLFFDY

SEQ ID NO: 2178 - protein, 9 aa, Homo sapiens
SEGTIFGVD

SEQ ID NO: 2179 - protein, 16 aa, Homo sapiens
MEYDILTGYYGGYFDY

SEQ ID NO: 2180 - protein, 14 aa, Homo sapiens
AGNEYGHTERPADY

SEQ ID NO: 2181 - protein, 19 aa, Homo sapiens
GKGYYDILTGYYRDNWFDP

SEQ ID NO: 2182 - protein, 17 aa, Homo sapiens
EGMNDFINSHHYYTMDA

SEQ ID NO: 2183 - protein, 19 aa, Homo sapiens
DAQSYYDILTGYQSYAFDI

SEQ ID NO: 2184 - protein, 11 aa, Homo sapiens
SLATRPLGMDV

SEQ ID NO: 2185 - protein, 15 aa, Homo sapiens
ENYDSLTGYYGAFDI

SEQ ID NO: 2186 - protein, 16 aa, Homo sapiens
KLGLSIVGATTGALDM

SEQ ID NO: 2187 - protein, 15 aa, Homo sapiens
DHFDTLTGYFRRLDS

SEQ ID NO: 2188 - protein, 22 aa, Homo sapiens
DGRLSYDILTGYYARDYYGMDD

SEQ ID NO: 2189 - protein, 22 aa, Homo sapiens
TPSSVYDLLTGYYHYFYSYMDV

SEQ ID NO: 2190 - protein, 10 aa, Homo sapiens
EKSAAGYFDY

SEQ ID NO: 2191 - protein, 11 aa, Homo sapiens
DGYRTNDALDI

SEQ ID NO: 2192 - protein, 7 aa, Homo sapiens
TGSGFDY

SEQ ID NO: 2193 - protein, 6 aa, Homo sapiens
DWDMDV

SEQ ID NO: 2194 - protein, 12 aa, Homo sapiens
DSGSYYYDAFDI

SEQ ID NO: 2195 - protein, 11 aa, Homo sapiens
DNGGGTIGFDY

SEQ ID NO: 2196 - protein, 12 aa, Homo sapiens
ESGAGGYYYDDY

SEQ ID NO: 2197 - protein, 13 aa, Homo sapiens
VGIKAAAVDNFEY

SEQ ID NO: 2198 - protein, 13 aa, Homo sapiens
DASRDIVVLPLAI

SEQ ID NO: 2199 - protein, 7 aa, Homo sapiens
NLWGLDY

SEQ ID NO: 2200 - protein, 10 aa, Homo sapiens
VHSTGYAFEN

SEQ ID NO: 2201 - protein, 17 aa, Homo sapiens
EYSGYHYVEGGSYAMDV

SEQ ID NO: 2202 - protein, 9 aa, Homo sapiens
DNLHAAFDI

SEQ ID NO: 2203 - protein, 5 aa, Homo sapiens
DTTDY

SEQ ID NO: 2204 - protein, 16 aa, Homo sapiens
EGGGDAYDVAPYYFDY

SEQ ID NO: 2205 - protein, 9 aa, Homo sapiens
WTSSGAFDI

SEQ ID NO: 2206 - protein, 13 aa, Homo sapiens
YYYHSSGSDAFDI

SEQ ID NO: 2207 - protein, 12 aa, Homo sapiens
DLGIAGTIYFDY

SEQ ID NO: 2208 - protein, 6 aa, Homo sapiens
DLDFDY

SEQ ID NO: 2209 - protein, 11 aa, Homo sapiens
EGPGYYYGMDV

SEQ ID NO: 2210 - protein, 5 aa, Homo sapiens
FVLDY

SEQ ID NO: 2211 - protein, 9 aa, Homo sapiens
GNAWGAFDI

SEQ ID NO: 2212 - protein, 13 aa, Homo sapiens
DRGSGWPNWYFDL

SEQ ID NO: 2213 - protein, 15 aa, Homo sapiens
PFYDTLTSYVSSLLS

SEQ ID NO: 2214 - protein, 16 aa, Homo sapiens
PFYDTLTSYVLHYYAH

SEQ ID NO: 2215 - protein, 16 aa, Homo sapiens
PFYDTLTSYVLHYYAL

SEQ ID NO: 2216 - protein, 16 aa, Homo sapiens
PFYDTLTSYVLHYYLY

SEQ ID NO: 2217 - protein, 16 aa, Homo sapiens
PFYDTLTSYVLHYYSA

SEQ ID NO: 2218 - protein, 16 aa, Homo sapiens
PFYDTLTSYVFHFYPV

SEQ ID NO: 2219 - protein, 16 aa, Homo sapiens
PFYDTLTSYVLHYYTH

SEQ ID NO: 2220 - protein, 16 aa, Homo sapiens
PFYDTLTSYVLMYFPH

SEQ ID NO: 2221 - protein, 16 aa, Homo sapiens
PFYDALTSYVFQYFDH

SEQ ID NO: 2222 - protein, 16 aa, Homo sapiens
PFYDTLTSYVLPFYAL

SEQ ID NO: 2223 - protein, 15 aa, Homo sapiens
PFYDTLTSYVLPLDS

SEQ ID NO: 2224 - protein, 15 aa, Homo sapiens
PFYDTLTSYVLPLLS

SEQ ID NO: 2225 - protein, 15 aa, Homo sapiens
PFYDTLTSYVLPPSV

SEQ ID NO: 2226 - protein, 16 aa, Homo sapiens
PFYDTLTSYVLKYYTD

SEQ ID NO: 2227 - protein, 16 aa, Homo sapiens
PFYDTLTSYVLPRVIP

SEQ ID NO: 2228 - protein, 16 aa, Homo sapiens
PFYDTLTSYVLPVWVS

SEQ ID NO: 2229 - protein, 16 aa, Homo sapiens
PFYDTLTSYVLPYLTH

SEQ ID NO: 2230 - protein, 16 aa, Homo sapiens
PFYDTLTSYAFQYFDH

SEQ ID NO: 2231 - protein, 16 aa, Homo sapiens
PFYDTLTSYVLPYYTL

SEQ ID NO: 2232 - protein, 16 aa, Homo sapiens
PFYDTLTSYGFQYFDH

SEQ ID NO: 2233 - protein, 16 aa, Homo sapiens
PFYDTLTSYVLQVFDT

SEQ ID NO: 2234 - protein, 15 aa, Homo sapiens
PFYDTLTSYVALYRL

SEQ ID NO: 2235 - protein, 16 aa, Homo sapiens
PFYDTLTSYVLQYFRY

SEQ ID NO: 2236 - protein, 15 aa, Homo sapiens
PFYDTLTSYVCRHLF

SEQ ID NO: 2237 - protein, 16 aa, Homo sapiens
PFYDTLTSYVLQYYVL

SEQ ID NO: 2238 - protein, 15 aa, Homo sapiens
PFYDTLTSYVCRPHF

SEQ ID NO: 2239 - protein, 15 aa, Homo sapiens
PFYDTLTSYVLRCVL

SEQ ID NO: 2240 - protein, 15 aa, Homo sapiens
PFYDTLTSYVCYPPA

SEQ ID NO: 2241 - protein, 16 aa, Homo sapiens
PFYDTLTSYVLRLPPQ

SEQ ID NO: 2242 - protein, 16 aa, Homo sapiens
PFYDTLTSYVFAPLVT

SEQ ID NO: 2243 - protein, 15 aa, Homo sapiens
PFYDTLTSYVLRSRD

SEQ ID NO: 2244 - protein, 16 aa, Homo sapiens
PFYDTLTSYVFDYYAS

SEQ ID NO: 2245 - protein, 16 aa, Homo sapiens
PFYDTLTSYVFEFLPL

SEQ ID NO: 2246 - protein, 16 aa, Homo sapiens
PFYDTLTSYVLSFYPV

SEQ ID NO: 2247 - protein, 16 aa, Homo sapiens
PFYDTLTSYVLWFYPL

SEQ ID NO: 2248 - protein, 16 aa, Homo sapiens
PFYDTLTSYVFEYFSV

SEQ ID NO: 2249 - protein, 16 aa, Homo sapiens
PFYDTLTSYVLWYYQD

SEQ ID NO: 2250 - protein, 16 aa, Homo sapiens
PFYDTLTSYVFFFYPF

SEQ ID NO: 2251 - protein, 16 aa, Homo sapiens
PFYDTLTSYVLYYYAF

SEQ ID NO: 2252 - protein, 16 aa, Homo sapiens
PFYDTLTSYVFGFYPF

SEQ ID NO: 2253 - protein, 16 aa, Homo sapiens
PFYDTLTSYVMDFYSV

SEQ ID NO: 2254 - protein, 16 aa, Homo sapiens
PFYDTLTSYVFGYYSL

SEQ ID NO: 2255 - protein, 16 aa, Homo sapiens
PFYDTLTSYVMHAYPL

SEQ ID NO: 2256 - protein, 16 aa, Homo sapiens
PFYDTLTSYVFHYLPV

SEQ ID NO: 2257 - protein, 16 aa, Homo sapiens
PFYDTLTSYVMHYLPV

SEQ ID NO: 2258 - protein, 16 aa, Homo sapiens
PFYDTLTSYVFHYYDV

SEQ ID NO: 2259 - protein, 16 aa, Homo sapiens
PFYDTLTSYVMHYYPT

SEQ ID NO: 2260 - protein, 16 aa, Homo sapiens
PFYDTLTSYVFHYYPL

SEQ ID NO: 2261 - protein, 16 aa, Homo sapiens
PFYDTLTSYVPCSPPR

SEQ ID NO: 2262 - protein, 16 aa, Homo sapiens
PFYDTLTSYVFPFYPH

SEQ ID NO: 2263 - protein, 16 aa, Homo sapiens
PFYDTLTSYVPLLPLC

SEQ ID NO: 2264 - protein, 16 aa, Homo sapiens
PFYDTLTSYVFPVYYL

SEQ ID NO: 2265 - protein, 12 aa, Homo sapiens
ASYLSTSSSLDN

SEQ ID NO: 2266 - protein, 16 aa, Homo sapiens
PFYDTLTSYVPPPSFL

SEQ ID NO: 2267 - protein, 15 aa, Homo sapiens
PFYDTLTSYVPSVGG

SEQ ID NO: 2268 - protein, 16 aa, Homo sapiens
PFYDTLTSYVFQYFAH

SEQ ID NO: 2269 - protein, 15 aa, Homo sapiens
PFYDTLTSYVPTSTT

SEQ ID NO: 2270 - protein, 15 aa, Homo sapiens
PFYDTLTSYVPVPST

SEQ ID NO: 2271 - protein, 15 aa, Homo sapiens
PFYDTLTSYVRASFS

SEQ ID NO: 2272 - protein, 15 aa, Homo sapiens
PFYDTLTSYVRCPYV

SEQ ID NO: 2273 - protein, 16 aa, Homo sapiens
PFYDTLTSYVRPFYAH

SEQ ID NO: 2274 - protein, 16 aa, Homo sapiens
PFYDTLTSYVSALPPP

SEQ ID NO: 2275 - protein, 15 aa, Homo sapiens
PFYDTLTSYVTPRGY

SEQ ID NO: 2276 - protein, 15 aa, Homo sapiens
PFYDTLTSYVTTPCT

SEQ ID NO: 2277 - protein, 16 aa, Homo sapiens
PFYDTLTSYVWPSFFS

SEQ ID NO: 2278 - protein, 16 aa, Homo sapiens
PIYDTLTSYVFQYFDH

SEQ ID NO: 2279 - protein, 16 aa, Homo sapiens
PFYDTLTSYVFQYFDR

SEQ ID NO: 2280 - protein, 16 aa, Homo sapiens
PFYDTLTSYVFQYFDY

SEQ ID NO: 2281 - protein, 15 aa, Homo sapiens
PFYDTLTSYVFRPDL

SEQ ID NO: 2282 - protein, 15 aa, Homo sapiens
PFYDTLTSYVGIHGL

SEQ ID NO: 2283 - protein, 16 aa, Homo sapiens
PFYDTLTSYVHEFFSL

SEQ ID NO: 2284 - protein, 15 aa, Homo sapiens
PFYDTLTSYVGPYGT

SEQ ID NO: 2285 - protein, 15 aa, Homo sapiens
PFYDTLTSYVHPSRS

SEQ ID NO: 2286 - protein, 15 aa, Homo sapiens
PFYDTLTSYVPPTRH

SEQ ID NO: 2287 - protein, 16 aa, Homo sapiens
PFYDTLTSYVIEYLPL

SEQ ID NO: 2288 - protein, 16 aa, Homo sapiens
PFYDTLTSYVIEYYPV

SEQ ID NO: 2289 - protein, 16 aa, Homo sapiens
PFYDTLTSYVIFYYPT

SEQ ID NO: 2290 - protein, 16 aa, Homo sapiens
PFYDTLTSYVIPFLPL

SEQ ID NO: 2291 - protein, 16 aa, Homo sapiens
PFYDTLTSYVIGFYPV

SEQ ID NO: 2292 - protein, 15 aa, Homo sapiens
PFYDTLTSYVPFLYC

SEQ ID NO: 2293 - protein, 16 aa, Homo sapiens
PFYDTLTSYVIHFYSL

SEQ ID NO: 2294 - protein, 16 aa, Homo sapiens
PFYDTLTSYVIHYLVT

SEQ ID NO: 2295 - protein, 16 aa, Homo sapiens
PFYDTLTSYVILYYLH

SEQ ID NO: 2296 - protein, 16 aa, Homo sapiens
PFYDTLTSYVIPFYPL

SEQ ID NO: 2297 - protein, 16 aa, Homo sapiens
PFYDTLTSYVIQYFDH

SEQ ID NO: 2298 - protein, 16 aa, Homo sapiens
PFYDTLTSYVLHYYPI

SEQ ID NO: 2299 - protein, 16 aa, Homo sapiens
PFYDTLTSYVISCSWA

SEQ ID NO: 2300 - protein, 16 aa, Homo sapiens
PFYDTLTSYVFGFFPH

SEQ ID NO: 2301 - protein, 16 aa, Homo sapiens
PFYDTLTSYVLHFIDH

SEQ ID NO: 2302 - protein, 16 aa, Homo sapiens
PFYDTLTSYVLHFYRV

SEQ ID NO: 2303 - protein, 16 aa, Homo sapiens
PFYDTLTSYVLEFYLL

SEQ ID NO: 2304 - protein, 16 aa, Homo sapiens
PFYDTLTSYVIPFLTH

SEQ ID NO: 2305 - protein, 15 aa, Homo sapiens
PFYDTLTSYVKSMPT

SEQ ID NO: 2306 - protein, 16 aa, Homo sapiens
PFYDTLTSYVLAYYPD

SEQ ID NO: 2307 - protein, 16 aa, Homo sapiens
PFYDTLTSYVVSFPSL

SEQ ID NO: 2308 - protein, 16 aa, Homo sapiens
PFYDTLTSYVLDFYSV

SEQ ID NO: 2309 - protein, 16 aa, Homo sapiens
PFYDTLTSYVLDYYSS

SEQ ID NO: 2310 - protein, 15 aa, Homo sapiens
PFYDTLTSYVPLLPP

SEQ ID NO: 2311 - protein, 16 aa, Homo sapiens
PFYDTLTSYVLEAFSL

SEQ ID NO: 2312 - protein, 16 aa, Homo sapiens
PFYDTLTSYVLEFFPA

SEQ ID NO: 2313 - protein, 16 aa, Homo sapiens
PFYDTLTSYVLEFFPD

SEQ ID NO: 2314 - protein, 16 aa, Homo sapiens
PFYDTLTSYVLHYLPL

SEQ ID NO: 2315 - protein, 16 aa, Homo sapiens
PFYDTLTSYVLEFFSH

SEQ ID NO: 2316 - protein, 16 aa, Homo sapiens
PFYDTLTSYVLHYYAY

SEQ ID NO: 2317 - protein, 16 aa, Homo sapiens
PFYDTLTSYVLYFYPS

SEQ ID NO: 2318 - protein, 16 aa, Homo sapiens
PFYDTLTSYVLEVYHP

SEQ ID NO: 2319 - protein, 15 aa, Homo sapiens
PFYDTLTSYVCTPVP

SEQ ID NO: 2320 - protein, 16 aa, Homo sapiens
PFYDTLTSYVLEYFPL

SEQ ID NO: 2321 - protein, 16 aa, Homo sapiens
PFYDTLTSYVMQFFPT

SEQ ID NO: 2322 - protein, 16 aa, Homo sapiens
PFYDTLTSYVMGVTPS

SEQ ID NO: 2323 - protein, 16 aa, Homo sapiens
PFYDTLTNYVFEYYAS

SEQ ID NO: 2324 - protein, 16 aa, Homo sapiens
PFYDTLTSYVFEYYSL

SEQ ID NO: 2325 - protein, 16 aa, Homo sapiens
PFYDTLTSYVLFFYPL

SEQ ID NO: 2326 - protein, 16 aa, Homo sapiens
PFYDTLTSYVLFRPVL

SEQ ID NO: 2327 - protein, 16 aa, Homo sapiens
PFYDTLTSYVLFYYPL

SEQ ID NO: 2328 - protein, 15 aa, Homo sapiens
PFYDTLTSYVLALDL

SEQ ID NO: 2329 - protein, 16 aa, Homo sapiens
PFYDTLTSYVLGFYPV

SEQ ID NO: 2330 - protein, 16 aa, Homo sapiens
PFYDTLTSYVIHFLPL

SEQ ID NO: 2331 - protein, 16 aa, Homo sapiens
PFYDTLTSYVLFYYTA

SEQ ID NO: 2332 - protein, 16 aa, Homo sapiens
PFYDTLTSYVLHAYAF

SEQ ID NO: 2333 - protein, 16 aa, Homo sapiens
PFYDTLTSYVLHFYPL

SEQ ID NO: 2334 - protein, 16 aa, Homo sapiens
PFYDTLTSYVLPVYDH

SEQ ID NO: 2335 - protein, 16 aa, Homo sapiens
PFYDTLTSYVLHIYPH

SEQ ID NO: 2336 - protein, 16 aa, Homo sapiens
PFYDTLTSYVLHYHTH

SEQ ID NO: 2337 - protein, 16 aa, Homo sapiens
PFYDTLTSYVLHYLPV

SEQ ID NO: 2338 - protein, 14 aa, Homo sapiens
SRDLLLFPSSVLWP

SEQ ID NO: 2339 - protein, 14 aa, Homo sapiens
SRDLLLFPSSYLEF

SEQ ID NO: 2340 - protein, 14 aa, Homo sapiens
SRDLLLFPSWPLTF

SEQ ID NO: 2341 - protein, 14 aa, Homo sapiens
SRDLLLFPTAALSF

SEQ ID NO: 2342 - protein, 14 aa, Homo sapiens
SRDLLLFPTAPLAF

SEQ ID NO: 2343 - protein, 14 aa, Homo sapiens
SRDLLLFPTAPLDF

SEQ ID NO: 2344 - protein, 14 aa, Homo sapiens
SRDLLLFPHYPLLF

SEQ ID NO: 2345 - protein, 14 aa, Homo sapiens
SRDLLLFPTAPLDP

SEQ ID NO: 2346 - protein, 14 aa, Homo sapiens
SRDLLLFPQDPLHP

SEQ ID NO: 2347 - protein, 14 aa, Homo sapiens
SRDLLLFPTAPLEI

SEQ ID NO: 2348 - protein, 14 aa, Homo sapiens
SRDLLLFPHFPLHP

SEQ ID NO: 2349 - protein, 14 aa, Homo sapiens
SRDLLLFPTAPLFP

SEQ ID NO: 2350 - protein, 14 aa, Homo sapiens
SRDLLLFPHLPLLF

SEQ ID NO: 2351 - protein, 14 aa, Homo sapiens
SRDLLLFPTAPLHP

SEQ ID NO: 2352 - protein, 14 aa, Homo sapiens
SRDLLLFPSAPLWP

SEQ ID NO: 2353 - protein, 14 aa, Homo sapiens
SRDLLLFPHDPLGF

SEQ ID NO: 2354 - protein, 14 aa, Homo sapiens
SRDLLLFPHEHLSF

SEQ ID NO: 2355 - protein, 14 aa, Homo sapiens
SRDLLLFPNDPLFG

SEQ ID NO: 2356 - protein, 14 aa, Homo sapiens
SRDLLLFPSEPLRI

SEQ ID NO: 2357 - protein, 14 aa, Homo sapiens
SRDLLLFPHYPLHP

SEQ ID NO: 2358 - protein, 14 aa, Homo sapiens
SRDLLLFPGRPLTF

SEQ ID NO: 2359 - protein, 14 aa, Homo sapiens
SRDLLLFPLDPLHF

SEQ ID NO: 2360 - protein, 14 aa, Homo sapiens
SRDLLLFPRDPLRF

SEQ ID NO: 2361 - protein, 14 aa, Homo sapiens
SRDLLLFPYAPLDF

SEQ ID NO: 2362 - protein, 14 aa, Homo sapiens
SRDLLLFPNSPLSP

SEQ ID NO: 2363 - protein, 13 aa, Homo sapiens
SRDLLLFPHDPLE

SEQ ID NO: 2364 - protein, 14 aa, Homo sapiens
SRDLLLFPASPLNP

SEQ ID NO: 2365 - protein, 14 aa, Homo sapiens
SRDLLLFPHTHLTF

SEQ ID NO: 2366 - protein, 14 aa, Homo sapiens
SRDLLLFPKHPLVF

SEQ ID NO: 2367 - protein, 14 aa, Homo sapiens
SRDLLLFPRAPLDF

SEQ ID NO: 2368 - protein, 14 aa, Homo sapiens
SRDLLLFPRDPLSF

SEQ ID NO: 2369 - protein, 14 aa, Homo sapiens
SRDLLLFPHAPLDP

SEQ ID NO: 2370 - protein, 14 aa, Homo sapiens
SRDLLLFPHAPLHP

SEQ ID NO: 2371 - protein, 14 aa, Homo sapiens
SRDLLLFPNAPLSP

SEQ ID NO: 2372 - protein, 14 aa, Homo sapiens
SRDLLLFPQDPLSP

SEQ ID NO: 2373 - protein, 14 aa, Homo sapiens
SRDLLLFPRTPLLF

SEQ ID NO: 2374 - protein, 14 aa, Homo sapiens
SRDLLLFPYSGLDA

SEQ ID NO: 2375 - protein, 14 aa, Homo sapiens
SRDLLLFPHTPLRF

SEQ ID NO: 2376 - protein, 14 aa, Homo sapiens
SRDLLLFPTSPLQL

SEQ ID NO: 2377 - protein, 14 aa, Homo sapiens
SRDLLLFPHHPLTF

SEQ ID NO: 2378 - protein, 14 aa, Homo sapiens
SRDLLLFPQAPLYP

SEQ ID NO: 2379 - protein, 14 aa, Homo sapiens
SRDLLLFPTAPLDL

SEQ ID NO: 2380 - protein, 14 aa, Homo sapiens
SRDLLLFPTFPLLF

SEQ ID NO: 2381 - protein, 14 aa, Homo sapiens
SRDLLLFPDAPLAP

SEQ ID NO: 2382 - protein, 14 aa, Homo sapiens
SRDLLLFPKAPLTF

SEQ ID NO: 2383 - protein, 14 aa, Homo sapiens
SRDLLLFPHDSFFL

SEQ ID NO: 2384 - protein, 14 aa, Homo sapiens
SRDLLLFPKSPILF

SEQ ID NO: 2385 - protein, 14 aa, Homo sapiens
SRDLLLFPYAPLSF

SEQ ID NO: 2386 - protein, 14 aa, Homo sapiens
SRDLLLFPNAALYP

SEQ ID NO: 2387 - protein, 14 aa, Homo sapiens
SRDLLLFPSAPLYP

SEQ ID NO: 2388 - protein, 14 aa, Homo sapiens
SRDLLLFPNSPLFP

SEQ ID NO: 2389 - protein, 14 aa, Homo sapiens
SRDLLLFPGSPLTF

SEQ ID NO: 2390 - protein, 14 aa, Homo sapiens
SRDLLLFPASPLSF

SEQ ID NO: 2391 - protein, 14 aa, Homo sapiens
SRDLLLFPADSLSF

SEQ ID NO: 2392 - protein, 14 aa, Homo sapiens
SRDLLLFPHSSLVF

SEQ ID NO: 2393 - protein, 14 aa, Homo sapiens
SRDLLLFPKHPLRF

SEQ ID NO: 2394 - protein, 14 aa, Homo sapiens
SRDLLLFPSAPLAP

SEQ ID NO: 2395 - protein, 14 aa, Homo sapiens
SRDLLLFPRDPLQF

SEQ ID NO: 2396 - protein, 14 aa, Homo sapiens
SRDLLLFPLSPLVP

SEQ ID NO: 2397 - protein, 14 aa, Homo sapiens
ARDLLLFPAAPLWP

SEQ ID NO: 2398 - protein, 14 aa, Homo sapiens
SRDLLLFPAAHLSF

SEQ ID NO: 2399 - protein, 14 aa, Homo sapiens
SRDLLLFPHFPLIF

SEQ ID NO: 2400 - protein, 14 aa, Homo sapiens
SRDLLLFPHGPLLI

SEQ ID NO: 2401 - protein, 14 aa, Homo sapiens
SRDLLLFPAAPLAF

SEQ ID NO: 2402 - protein, 14 aa, Homo sapiens
SRDLLLFPHGPLTF

SEQ ID NO: 2403 - protein, 14 aa, Homo sapiens
SRDLLLFPAAPLLF

SEQ ID NO: 2404 - protein, 14 aa, Homo sapiens
SRDLLLFPHHALDV

SEQ ID NO: 2405 - protein, 14 aa, Homo sapiens
SRDLLLFPAAPLSP

SEQ ID NO: 2406 - protein, 14 aa, Homo sapiens
SRDLLLFPHHGFDA

SEQ ID NO: 2407 - protein, 14 aa, Homo sapiens
SRDLLLFPAAPLTP

SEQ ID NO: 2408 - protein, 14 aa, Homo sapiens
SRDLLLFPAEHLLF

SEQ ID NO: 2409 - protein, 14 aa, Homo sapiens
SRDLLLFPHHPLDS

SEQ ID NO: 2410 - protein, 14 aa, Homo sapiens
SRDLLLFPAGPLRF

SEQ ID NO: 2411 - protein, 14 aa, Homo sapiens
SRDLLLFPHHPLEP

SEQ ID NO: 2412 - protein, 14 aa, Homo sapiens
SRDLLLFPAHPLLF

SEQ ID NO: 2413 - protein, 14 aa, Homo sapiens
SRDLLLFPHHPLQF

SEQ ID NO: 2414 - protein, 14 aa, Homo sapiens
SRDLLLFPAHPLVI

SEQ ID NO: 2415 - protein, 14 aa, Homo sapiens
SRDLLLFPHHPLSF

SEQ ID NO: 2416 - protein, 14 aa, Homo sapiens
SRDLLLFPAKPLLF

SEQ ID NO: 2417 - protein, 14 aa, Homo sapiens
SRDLLLFPASPLIF

SEQ ID NO: 2418 - protein, 14 aa, Homo sapiens
SRDLLLFPHHRFDL

SEQ ID NO: 2419 - protein, 14 aa, Homo sapiens
SRDLLLFPHHSFDA

SEQ ID NO: 2420 - protein, 14 aa, Homo sapiens
SRDLLLFPASPLTF

SEQ ID NO: 2421 - protein, 14 aa, Homo sapiens
SRDLLLFPDAALRF

SEQ ID NO: 2422 - protein, 14 aa, Homo sapiens
SRDLLLFPHHSFDS

SEQ ID NO: 2423 - protein, 14 aa, Homo sapiens
SRDLLLFPDAPLFP

SEQ ID NO: 2424 - protein, 14 aa, Homo sapiens
SRDLLLFPHHSFDT

SEQ ID NO: 2425 - protein, 14 aa, Homo sapiens
SRDLLLFPDAPLHP

SEQ ID NO: 2426 - protein, 14 aa, Homo sapiens
SRDLLLFPDAPLTP

SEQ ID NO: 2427 - protein, 14 aa, Homo sapiens
SRDLLLFPHHSLFF

SEQ ID NO: 2428 - protein, 14 aa, Homo sapiens
SRDLLLFPDDGLSS

SEQ ID NO: 2429 - protein, 14 aa, Homo sapiens
SRDLLLFPHHSLLF

SEQ ID NO: 2430 - protein, 14 aa, Homo sapiens
SRDLLLFPDDPLLS

SEQ ID NO: 2431 - protein, 14 aa, Homo sapiens
SRDLLLFPHLPLTP

SEQ ID NO: 2432 - protein, 14 aa, Homo sapiens
SRDLLLFPDDPLSF

SEQ ID NO: 2433 - protein, 14 aa, Homo sapiens
SRDLLLFPDFPMAP

SEQ ID NO: 2434 - protein, 14 aa, Homo sapiens
SRDLLLFPQEPLAP

SEQ ID NO: 2435 - protein, 14 aa, Homo sapiens
SRDLLLFPQEPLSP

SEQ ID NO: 2436 - protein, 14 aa, Homo sapiens
SRDLLLFPHQPLTF

SEQ ID NO: 2437 - protein, 14 aa, Homo sapiens
SRDLLLFPQESFSL

SEQ ID NO: 2438 - protein, 14 aa, Homo sapiens
SRDLLLFPHSILHP

SEQ ID NO: 2439 - protein, 14 aa, Homo sapiens
SRDLLLFPDHAFFV

SEQ ID NO: 2440 - protein, 14 aa, Homo sapiens
SRDLLLFPQGPLRF

SEQ ID NO: 2441 - protein, 14 aa, Homo sapiens
SRDLLLFPHSPITF

SEQ ID NO: 2442 - protein, 14 aa, Homo sapiens
SRDLLLFPDHPLLF

SEQ ID NO: 2443 - protein, 14 aa, Homo sapiens
SRDLLLFPQGPLSF

SEQ ID NO: 2444 - protein, 14 aa, Homo sapiens
SRDLLLFPHSPLDF

SEQ ID NO: 2445 - protein, 14 aa, Homo sapiens
SRDLLLFPDSPLAP

SEQ ID NO: 2446 - protein, 14 aa, Homo sapiens
SRDLLLFPQHGFDA

SEQ ID NO: 2447 - protein, 14 aa, Homo sapiens
SRDLLLFPHSPLFP

SEQ ID NO: 2448 - protein, 14 aa, Homo sapiens
SRDLLLFPEGPLLF

SEQ ID NO: 2449 - protein, 14 aa, Homo sapiens
SRDLLLFPQHGLDL

SEQ ID NO: 2450 - protein, 14 aa, Homo sapiens
SRDLLLFPHSPLHS

SEQ ID NO: 2451 - protein, 14 aa, Homo sapiens
SRDLLLFPFAPLRF

SEQ ID NO: 2452 - protein, 14 aa, Homo sapiens
SRDLLLFPQHPLSP

SEQ ID NO: 2453 - protein, 14 aa, Homo sapiens
SRDLLLFPHSPLLI

SEQ ID NO: 2454 - protein, 14 aa, Homo sapiens
SRDLLLFPFDPLLI

SEQ ID NO: 2455 - protein, 14 aa, Homo sapiens
SRDLLLFPQSPLHP

SEQ ID NO: 2456 - protein, 13 aa, Homo sapiens
SRDLLLFPHSPLL

SEQ ID NO: 2457 - protein, 14 aa, Homo sapiens
SRDLLLFPFEPLII

SEQ ID NO: 2458 - protein, 14 aa, Homo sapiens
SRDLLLFPQSPLLF

SEQ ID NO: 2459 - protein, 14 aa, Homo sapiens
SRDLLLFPHSPLRI

SEQ ID NO: 2460 - protein, 14 aa, Homo sapiens
SRDLLLFPFFPLQF

SEQ ID NO: 2461 - protein, 14 aa, Homo sapiens
SRDLLLFPHSPLSF

SEQ ID NO: 2462 - protein, 14 aa, Homo sapiens
SRDLLLFPFGTLRF

SEQ ID NO: 2463 - protein, 14 aa, Homo sapiens
SRDLLLFPHDPLYI

SEQ ID NO: 2464 - protein, 14 aa, Homo sapiens
SRDLLLFPFSPLAP

SEQ ID NO: 2465 - protein, 14 aa, Homo sapiens
SRDLLLFPSSPLIL

SEQ ID NO: 2466 - protein, 14 aa, Homo sapiens
SRDLLLFPQSPLYP

SEQ ID NO: 2467 - protein, 14 aa, Homo sapiens
SRDLLLFPQTPLFP

SEQ ID NO: 2468 - protein, 13 aa, Homo sapiens
SRDLLLFPHSPLT

SEQ ID NO: 2469 - protein, 14 aa, Homo sapiens
SRDLLLFPRAHLRF

SEQ ID NO: 2470 - protein, 13 aa, Homo sapiens
SRDLLLFPHSPLY

SEQ ID NO: 2471 - protein, 14 aa, Homo sapiens
SRDLLLFPFSPLLF

SEQ ID NO: 2472 - protein, 14 aa, Homo sapiens
SRDLLLFPRAPLAF

SEQ ID NO: 2473 - protein, 14 aa, Homo sapiens
SRDLLLFPHSSLDF

SEQ ID NO: 2474 - protein, 14 aa, Homo sapiens
SRDLLLFPFTPLTF

SEQ ID NO: 2475 - protein, 14 aa, Homo sapiens
SRDLLLFPHAPLEL

SEQ ID NO: 2476 - protein, 14 aa, Homo sapiens
SRDLLLFPRAPLAP

SEQ ID NO: 2477 - protein, 14 aa, Homo sapiens
SRDLLLFPHSYLSP

SEQ ID NO: 2478 - protein, 14 aa, Homo sapiens
SRDLLLFPGAPLSP

SEQ ID NO: 2479 - protein, 14 aa, Homo sapiens
SRDLLLFPTEPLVL

SEQ ID NO: 2480 - protein, 14 aa, Homo sapiens
SRDLLLFPHTPLDS

SEQ ID NO: 2481 - protein, 14 aa, Homo sapiens
SRDLLLFPGDPLDF

SEQ ID NO: 2482 - protein, 14 aa, Homo sapiens
SRHLLLFPQGPLSF

SEQ ID NO: 2483 - protein, 14 aa, Homo sapiens
SRDLLLFPDWPLYP

SEQ ID NO: 2484 - protein, 14 aa, Homo sapiens
SRDLLLFPGSPLHP

SEQ ID NO: 2485 - protein, 14 aa, Homo sapiens
SRDLLLFPHTPLHF

SEQ ID NO: 2486 - protein, 14 aa, Homo sapiens
SRDLLLFPRAPLFF

SEQ ID NO: 2487 - protein, 14 aa, Homo sapiens
SRDLLLFPGAPLAP

SEQ ID NO: 2488 - protein, 14 aa, Homo sapiens
SRDLLLFPGSPLLD

SEQ ID NO: 2489 - protein, 14 aa, Homo sapiens
SRDLLLFPHTPLLF

SEQ ID NO: 2490 - protein, 14 aa, Homo sapiens
SRDLLLFPRAPLLF

SEQ ID NO: 2491 - protein, 14 aa, Homo sapiens
SRDLLLFPGSPLLF

SEQ ID NO: 2492 - protein, 14 aa, Homo sapiens
SRDLLLFPHTPLTF

SEQ ID NO: 2493 - protein, 14 aa, Homo sapiens
SRDLLLFPRAPLRF

SEQ ID NO: 2494 - protein, 14 aa, Homo sapiens
SRDLLLFPHLPLNP

SEQ ID NO: 2495 - protein, 14 aa, Homo sapiens
SRDLLLFPHTTLRF

SEQ ID NO: 2496 - protein, 14 aa, Homo sapiens
SRDLLLFPRAPLSF

SEQ ID NO: 2497 - protein, 14 aa, Homo sapiens
SRDLLLFPHTILYP

SEQ ID NO: 2498 - protein, 14 aa, Homo sapiens
SRDLLLFPHAGFDS

SEQ ID NO: 2499 - protein, 14 aa, Homo sapiens
SRDLLLFPMLGLDL

SEQ ID NO: 2500 - protein, 14 aa, Homo sapiens
SRDLLLFPRAPLTF

SEQ ID NO: 2501 - protein, 14 aa, Homo sapiens
SRDLLLFPRAPLYP

SEQ ID NO: 2502 - protein, 14 aa, Homo sapiens
SRDLLLFPRATLEF

SEQ ID NO: 2503 - protein, 14 aa, Homo sapiens
SRDLLLFPHANLSP

SEQ ID NO: 2504 - protein, 14 aa, Homo sapiens
SRDLLLFPHYGMYV

SEQ ID NO: 2505 - protein, 14 aa, Homo sapiens
SRDLLLFPRDPLAF

SEQ ID NO: 2506 - protein, 14 aa, Homo sapiens
SRDLLLFPQNPLHP

SEQ ID NO: 2507 - protein, 14 aa, Homo sapiens
SRDLLLFPHAPFTF

SEQ ID NO: 2508 - protein, 14 aa, Homo sapiens
SRDLLLFPHYPFDA

SEQ ID NO: 2509 - protein, 14 aa, Homo sapiens
SRDLLLFPRDPLDL

SEQ ID NO: 2510 - protein, 14 aa, Homo sapiens
SRDLLLFPHAPLAP

SEQ ID NO: 2511 - protein, 14 aa, Homo sapiens
SRDLLLFPHYPLFL

SEQ ID NO: 2512 - protein, 14 aa, Homo sapiens
SRDLLLFPRDPLHF

SEQ ID NO: 2513 - protein, 14 aa, Homo sapiens
SRDLLLFPHAPLDL

SEQ ID NO: 2514 - protein, 14 aa, Homo sapiens
SRDLLLFPTAPLLF

SEQ ID NO: 2515 - protein, 14 aa, Homo sapiens
SRDLLLFPRDPLLF

SEQ ID NO: 2516 - protein, 14 aa, Homo sapiens
SRDLLLFPRDPLEF

SEQ ID NO: 2517 - protein, 14 aa, Homo sapiens
SRDLLLFPHYSLLL

SEQ ID NO: 2518 - protein, 14 aa, Homo sapiens
SRDLLLFPTAPLNF

SEQ ID NO: 2519 - protein, 14 aa, Homo sapiens
SRDLLLFPRSALTF

SEQ ID NO: 2520 - protein, 14 aa, Homo sapiens
SRDLLLFPHAPLEA

SEQ ID NO: 2521 - protein, 14 aa, Homo sapiens
SRDLLLFPHYSLVL

SEQ ID NO: 2522 - protein, 14 aa, Homo sapiens
SRDLLLFPTAPLRF

SEQ ID NO: 2523 - protein, 14 aa, Homo sapiens
SRDLLLFPSQYLDF

SEQ ID NO: 2524 - protein, 13 aa, Homo sapiens
SRDLLLFPHAPLE

SEQ ID NO: 2525 - protein, 14 aa, Homo sapiens
SRDLLLFPHYTLLF

SEQ ID NO: 2526 - protein, 14 aa, Homo sapiens
SRDLLLFPTAPLSF

SEQ ID NO: 2527 - protein, 14 aa, Homo sapiens
SRDLLLFPRDPLRI

SEQ ID NO: 2528 - protein, 14 aa, Homo sapiens
SRDLLLFPTSPLQP

SEQ ID NO: 2529 - protein, 14 aa, Homo sapiens
SRDLLLFPHAPLFE

SEQ ID NO: 2530 - protein, 14 aa, Homo sapiens
SRDLLLFPISPLCF

SEQ ID NO: 2531 - protein, 14 aa, Homo sapiens
SRDLLLFPTAPLTF

SEQ ID NO: 2532 - protein, 14 aa, Homo sapiens
SRDLLLFPYHPLLF

SEQ ID NO: 2533 - protein, 14 aa, Homo sapiens
SRDLLLFPHAPLFP

SEQ ID NO: 2534 - protein, 14 aa, Homo sapiens
SRDLLLFPKAPLDF

SEQ ID NO: 2535 - protein, 14 aa, Homo sapiens
SRDLLLFPTAPLYG

SEQ ID NO: 2536 - protein, 14 aa, Homo sapiens
SRDLLLFPHYPLEM

SEQ ID NO: 2537 - protein, 14 aa, Homo sapiens
SRDLLLFPTDALRI

SEQ ID NO: 2538 - protein, 14 aa, Homo sapiens
SRDLLLFPHAPLDF

SEQ ID NO: 2539 - protein, 14 aa, Homo sapiens
SRDLLLFPTDALYF

SEQ ID NO: 2540 - protein, 14 aa, Homo sapiens
SRDLLLFPTEPLQF

SEQ ID NO: 2541 - protein, 14 aa, Homo sapiens
SRDLLLFPTFPLIF

SEQ ID NO: 2542 - protein, 14 aa, Homo sapiens
SRDLLLFPRGPLRF

SEQ ID NO: 2543 - protein, 14 aa, Homo sapiens
SRDLLLFPRHPLLF

SEQ ID NO: 2544 - protein, 14 aa, Homo sapiens
SRDLLLFPKAPLVF

SEQ ID NO: 2545 - protein, 14 aa, Homo sapiens
SRDLLLFPRHPLVF

SEQ ID NO: 2546 - protein, 14 aa, Homo sapiens
SRDLLLFPHAPLFT

SEQ ID NO: 2547 - protein, 14 aa, Homo sapiens
SRDLLLFPKSPLAF

SEQ ID NO: 2548 - protein, 14 aa, Homo sapiens
SRDLLLFPRPLLLF

SEQ ID NO: 2549 - protein, 14 aa, Homo sapiens
SRDLLLFPHSPLSP

SEQ ID NO: 2550 - protein, 14 aa, Homo sapiens
SRDLLLFPLAPLFF

SEQ ID NO: 2551 - protein, 14 aa, Homo sapiens
SRDLLLFPRSPLLF

SEQ ID NO: 2552 - protein, 14 aa, Homo sapiens
SRDLLLFPHAPLLL

SEQ ID NO: 2553 - protein, 14 aa, Homo sapiens
SRDLLLFPLAPLHP

SEQ ID NO: 2554 - protein, 13 aa, Homo sapiens
SRDLLLFPHAPLQ

SEQ ID NO: 2555 - protein, 14 aa, Homo sapiens
SRDLLLFPLAPLSF

SEQ ID NO: 2556 - protein, 14 aa, Homo sapiens
SRDLLLFPTHPLLF

SEQ ID NO: 2557 - protein, 14 aa, Homo sapiens
SRDLLLFPRSPLSF

SEQ ID NO: 2558 - protein, 14 aa, Homo sapiens
SRDLLLFPRDPLII

SEQ ID NO: 2559 - protein, 14 aa, Homo sapiens
SRDLLLFPHAPLRF

SEQ ID NO: 2560 - protein, 14 aa, Homo sapiens
SRDLLLFPLDPLII

SEQ ID NO: 2561 - protein, 14 aa, Homo sapiens
SRDLLLFPTHPLSF

SEQ ID NO: 2562 - protein, 14 aa, Homo sapiens
SRDLLLFPRSPLTF

SEQ ID NO: 2563 - protein, 14 aa, Homo sapiens
SRDLLLFPHSPLHP

SEQ ID NO: 2564 - protein, 14 aa, Homo sapiens
SRDLLLFPHAPLSF

SEQ ID NO: 2565 - protein, 14 aa, Homo sapiens
SRDLLLFPLEPMHF

SEQ ID NO: 2566 - protein, 14 aa, Homo sapiens
SRDLLLFPTQPLSF

SEQ ID NO: 2567 - protein, 14 aa, Homo sapiens
SRDLLLFPRTPLTF

SEQ ID NO: 2568 - protein, 14 aa, Homo sapiens
SRDLLLFPSDALSF

SEQ ID NO: 2569 - protein, 14 aa, Homo sapiens
SRDLLLFPHAPLSH

SEQ ID NO: 2570 - protein, 14 aa, Homo sapiens
SRDLLLFPLHPLIF

SEQ ID NO: 2571 - protein, 14 aa, Homo sapiens
SRDLLLFPTSPLFF

SEQ ID NO: 2572 - protein, 14 aa, Homo sapiens
SRDLLLFPRTYLDF

SEQ ID NO: 2573 - protein, 14 aa, Homo sapiens
SRDLLLFPHAPLSP

SEQ ID NO: 2574 - protein, 14 aa, Homo sapiens
SRDLLLFPLSPLSF

SEQ ID NO: 2575 - protein, 14 aa, Homo sapiens
SRDLLLFPTSPLRL

SEQ ID NO: 2576 - protein, 14 aa, Homo sapiens
SRDLLLFPSSPLHP

SEQ ID NO: 2577 - protein, 14 aa, Homo sapiens
SRDLLLFPHAPLTP

SEQ ID NO: 2578 - protein, 14 aa, Homo sapiens
SRDLLLFPLSPLWP

SEQ ID NO: 2579 - protein, 14 aa, Homo sapiens
SRDLLLFPTSPLSF

SEQ ID NO: 2580 - protein, 14 aa, Homo sapiens
SRDLLLFPHDPLLL

SEQ ID NO: 2581 - protein, 14 aa, Homo sapiens
SRDLLLFPHAPLVL

SEQ ID NO: 2582 - protein, 14 aa, Homo sapiens
SRDLLLFPTSPLTF

SEQ ID NO: 2583 - protein, 14 aa, Homo sapiens
SRDLLLFPTTPLHF

SEQ ID NO: 2584 - protein, 14 aa, Homo sapiens
SRDLLLFPTYPLHF

SEQ ID NO: 2585 - protein, 14 aa, Homo sapiens
SRDLLLFPRYPLFF

SEQ ID NO: 2586 - protein, 14 aa, Homo sapiens
SRDLLLFPSAHLLF

SEQ ID NO: 2587 - protein, 14 aa, Homo sapiens
SRDLLLFPLSSLEF

SEQ ID NO: 2588 - protein, 14 aa, Homo sapiens
SRDLLLFPSAPISF

SEQ ID NO: 2589 - protein, 14 aa, Homo sapiens
SRDLLLFPHAPLYF

SEQ ID NO: 2590 - protein, 14 aa, Homo sapiens
SRDLLLFPLTPLLI

SEQ ID NO: 2591 - protein, 14 aa, Homo sapiens
SRDLLLFPSAPIVF

SEQ ID NO: 2592 - protein, 14 aa, Homo sapiens
SRDLLLFPHAPLYP

SEQ ID NO: 2593 - protein, 14 aa, Homo sapiens
SRDLLLFPMAPLRF

SEQ ID NO: 2594 - protein, 14 aa, Homo sapiens
SRDLLLFPSAPLAF

SEQ ID NO: 2595 - protein, 14 aa, Homo sapiens
SRDLLLFPHAPMDP

SEQ ID NO: 2596 - protein, 14 aa, Homo sapiens
SRDLLLFPMAPLSP

SEQ ID NO: 2597 - protein, 14 aa, Homo sapiens
SRDLLLFPSAPLDF

SEQ ID NO: 2598 - protein, 14 aa, Homo sapiens
SRDLLLFPHDALQS

SEQ ID NO: 2599 - protein, 14 aa, Homo sapiens
SRDLLLFPMAPLVG

SEQ ID NO: 2600 - protein, 14 aa, Homo sapiens
SRDLLLFPTYPLSF

SEQ ID NO: 2601 - protein, 14 aa, Homo sapiens
SRDLLLFPSAPLDP

SEQ ID NO: 2602 - protein, 14 aa, Homo sapiens
SRDLLLFPHDHLLF

SEQ ID NO: 2603 - protein, 14 aa, Homo sapiens
SRDLLLFPNAPLDP

SEQ ID NO: 2604 - protein, 14 aa, Homo sapiens
SRDLLLFPTYPLVF

SEQ ID NO: 2605 - protein, 14 aa, Homo sapiens
SRDLLLFPSAPLHP

SEQ ID NO: 2606 - protein, 14 aa, Homo sapiens
SRDLLLFPHDPLAP

SEQ ID NO: 2607 - protein, 14 aa, Homo sapiens
SRDLLLFPNAPLDS

SEQ ID NO: 2608 - protein, 14 aa, Homo sapiens
SRDLLLFPYAPLAF

SEQ ID NO: 2609 - protein, 14 aa, Homo sapiens
SRDLLLFPSAPLRF

SEQ ID NO: 2610 - protein, 14 aa, Homo sapiens
SRDLLLFPNAPLHP

SEQ ID NO: 2611 - protein, 14 aa, Homo sapiens
SRDLLLFPSAPLSF

SEQ ID NO: 2612 - protein, 13 aa, Homo sapiens
SRDLLLFPHDPLI

SEQ ID NO: 2613 - protein, 14 aa, Homo sapiens
SRDLLLFPNAPLLL

SEQ ID NO: 2614 - protein, 14 aa, Homo sapiens
SRDLLLFPHDPLLF

SEQ ID NO: 2615 - protein, 14 aa, Homo sapiens
SRDLLLFPNAPLNP

SEQ ID NO: 2616 - protein, 14 aa, Homo sapiens
SRDLLLFPHDPLSP

SEQ ID NO: 2617 - protein, 14 aa, Homo sapiens
SRDLLLFPYAPLTF

SEQ ID NO: 2618 - protein, 14 aa, Homo sapiens
SRDLLLFPYATLSF

SEQ ID NO: 2619 - protein, 14 aa, Homo sapiens
SRDLLLFPHAAFDV

SEQ ID NO: 2620 - protein, 14 aa, Homo sapiens
SRDLLLFPYAVLHF

SEQ ID NO: 2621 - protein, 14 aa, Homo sapiens
SRDLLLFPYDPLHF

SEQ ID NO: 2622 - protein, 14 aa, Homo sapiens
SRDLLLFPTDSLLF

SEQ ID NO: 2623 - protein, 14 aa, Homo sapiens
SRDLLLFPSAPLSP

SEQ ID NO: 2624 - protein, 14 aa, Homo sapiens
SRDLLLFPSAPLSS

SEQ ID NO: 2625 - protein, 14 aa, Homo sapiens
SRDLLLFPNAPLSF

SEQ ID NO: 2626 - protein, 14 aa, Homo sapiens
SRDLLLFPSAPLTF

SEQ ID NO: 2627 - protein, 14 aa, Homo sapiens
SRDLLLFPHDPLTF

SEQ ID NO: 2628 - protein, 14 aa, Homo sapiens
SRDLLLFPHDPPRF

SEQ ID NO: 2629 - protein, 14 aa, Homo sapiens
SRDLLLFPNAVLDI

SEQ ID NO: 2630 - protein, 14 aa, Homo sapiens
SRDLLLFPSAPLTP

SEQ ID NO: 2631 - protein, 14 aa, Homo sapiens
SRDLLLFPHDSFDL

SEQ ID NO: 2632 - protein, 13 aa, Homo sapiens
SRDLLLFPNDALS

SEQ ID NO: 2633 - protein, 14 aa, Homo sapiens
SRDLLLFPHEPLAF

SEQ ID NO: 2634 - protein, 14 aa, Homo sapiens
SRDLLLFPNDPLLI

SEQ ID NO: 2635 - protein, 14 aa, Homo sapiens
SRDLLLFPYDPLHS

SEQ ID NO: 2636 - protein, 14 aa, Homo sapiens
SRDLLLFPHEPLCF

SEQ ID NO: 2637 - protein, 13 aa, Homo sapiens
SRDLLLFPNDPLR

SEQ ID NO: 2638 - protein, 14 aa, Homo sapiens
SRDLLLFPYDPLLF

SEQ ID NO: 2639 - protein, 14 aa, Homo sapiens
SRDLLLFPSDPLGF

SEQ ID NO: 2640 - protein, 14 aa, Homo sapiens
SRDLLLFPHEPLFP

SEQ ID NO: 2641 - protein, 14 aa, Homo sapiens
SRDLLLFPNDPLVL

SEQ ID NO: 2642 - protein, 14 aa, Homo sapiens
SRDLLLFPYEPLRF

SEQ ID NO: 2643 - protein, 14 aa, Homo sapiens
SRDLLLFPSDPLSA

SEQ ID NO: 2644 - protein, 14 aa, Homo sapiens
SRDLLLFPHEPLIF

SEQ ID NO: 2645 - protein, 14 aa, Homo sapiens
SRDLLLFPNGALRF

SEQ ID NO: 2646 - protein, 14 aa, Homo sapiens
SRDLLLFPYFPLVF

SEQ ID NO: 2647 - protein, 14 aa, Homo sapiens
SRDLLLFPSDPLSF

SEQ ID NO: 2648 - protein, 14 aa, Homo sapiens
SRDLLLFPHEPLLI

SEQ ID NO: 2649 - protein, 14 aa, Homo sapiens
SRDLLLFPNGPLHP

SEQ ID NO: 2650 - protein, 14 aa, Homo sapiens
SRDLLLFPYHSYDI

SEQ ID NO: 2651 - protein, 14 aa, Homo sapiens
SRDLLLFPHEPLSP

SEQ ID NO: 2652 - protein, 14 aa, Homo sapiens
SRDLLLFPNHAFDL

SEQ ID NO: 2653 - protein, 14 aa, Homo sapiens
SRDLLLFPYNPPIF

SEQ ID NO: 2654 - protein, 14 aa, Homo sapiens
SRDLLLFPHEPLTA

SEQ ID NO: 2655 - protein, 14 aa, Homo sapiens
SRDLLLFPYSHLEF

SEQ ID NO: 2656 - protein, 14 aa, Homo sapiens
SRDLLLFPYSPLAF

SEQ ID NO: 2657 - protein, 14 aa, Homo sapiens
SRDLLLFPYSPLFP

SEQ ID NO: 2658 - protein, 14 aa, Homo sapiens
SRDLLLFPYSPLHP

SEQ ID NO: 2659 - protein, 14 aa, Homo sapiens
SRDLLLFPSDPLSL

SEQ ID NO: 2660 - protein, 14 aa, Homo sapiens
SRDLLLFPSDPLVF

SEQ ID NO: 2661 - protein, 14 aa, Homo sapiens
SRDLLLFPNHPLTF

SEQ ID NO: 2662 - protein, 14 aa, Homo sapiens
SRDLLLFPSDSGFA

SEQ ID NO: 2663 - protein, 14 aa, Homo sapiens
SRDLLLFPNHPLYP

SEQ ID NO: 2664 - protein, 14 aa, Homo sapiens
SRDLLLFPSEPLFF

SEQ ID NO: 2665 - protein, 14 aa, Homo sapiens
SRDLLLFPNHPMFP

SEQ ID NO: 2666 - protein, 14 aa, Homo sapiens
SRDLLLFPSEPLQL

SEQ ID NO: 2667 - protein, 14 aa, Homo sapiens
SRDLLLFPNQPLSF

SEQ ID NO: 2668 - protein, 14 aa, Homo sapiens
SRDLLLFPSEPLWP

SEQ ID NO: 2669 - protein, 14 aa, Homo sapiens
SRDLLLFPNRGLDL

SEQ ID NO: 2670 - protein, 14 aa, Homo sapiens
SRDLLLFPYSPLLF

SEQ ID NO: 2671 - protein, 14 aa, Homo sapiens
SRDLLLFPSFPLLF

SEQ ID NO: 2672 - protein, 14 aa, Homo sapiens
SRDLLLFPNSPLAP

SEQ ID NO: 2673 - protein, 14 aa, Homo sapiens
SRDLLLFPYSPLQP

SEQ ID NO: 2674 - protein, 14 aa, Homo sapiens
SRDLLLFPSHAFDL

SEQ ID NO: 2675 - protein, 14 aa, Homo sapiens
SRDLLLFPNSPLHP

SEQ ID NO: 2676 - protein, 14 aa, Homo sapiens
SRDLLLFPYSPLSF

SEQ ID NO: 2677 - protein, 14 aa, Homo sapiens
SRDLLLFPSHAFHE

SEQ ID NO: 2678 - protein, 14 aa, Homo sapiens
SRDLLLFPNSTLSF

SEQ ID NO: 2679 - protein, 14 aa, Homo sapiens
SRDLLLFPYSPLTH

SEQ ID NO: 2680 - protein, 14 aa, Homo sapiens
SRDLLLFPSHPLFF

SEQ ID NO: 2681 - protein, 14 aa, Homo sapiens
SRDLLLFPQAPLEP

SEQ ID NO: 2682 - protein, 14 aa, Homo sapiens
SRDLLLFPYTPLLF

SEQ ID NO: 2683 - protein, 14 aa, Homo sapiens
SRDLLLFPQAPLFD

SEQ ID NO: 2684 - protein, 14 aa, Homo sapiens
SRYLLLFPDHSFDL

SEQ ID NO: 2685 - protein, 14 aa, Homo sapiens
SRYLLLFPHYGMDV

SEQ ID NO: 2686 - protein, 14 aa, Homo sapiens
SRYLLLFPHYPLLF

SEQ ID NO: 2687 - protein, 14 aa, Homo sapiens
SRDLLLFPSHPLLF

SEQ ID NO: 2688 - protein, 14 aa, Homo sapiens
SRDLLLFPSHPLSF

SEQ ID NO: 2689 - protein, 14 aa, Homo sapiens
SRDLLLFPQAPLFP

SEQ ID NO: 2690 - protein, 14 aa, Homo sapiens
SRDLLLFPSHPLTF

SEQ ID NO: 2691 - protein, 14 aa, Homo sapiens
SRDLLLFPQAPLHP

SEQ ID NO: 2692 - protein, 14 aa, Homo sapiens
SRDLLLFPSHSFDI

SEQ ID NO: 2693 - protein, 14 aa, Homo sapiens
SRDLLLFPSHSFDV

SEQ ID NO: 2694 - protein, 14 aa, Homo sapiens
SRDLLLFPQAPLLF

SEQ ID NO: 2695 - protein, 14 aa, Homo sapiens
SRDLLLFPSMPLTF

SEQ ID NO: 2696 - protein, 14 aa, Homo sapiens
SRDLLLFPQAPLSF

SEQ ID NO: 2697 - protein, 14 aa, Homo sapiens
SRYLLLFPYAPLYD

SEQ ID NO: 2698 - protein, 14 aa, Homo sapiens
SRDLLLFPSNPLTF

SEQ ID NO: 2699 - protein, 14 aa, Homo sapiens
SRDLLLFPQAPLSP

SEQ ID NO: 2700 - protein, 14 aa, Homo sapiens
SRDLLLFPHDGLAP

SEQ ID NO: 2701 - protein, 14 aa, Homo sapiens
SRDLLLFPSPYLSF

SEQ ID NO: 2702 - protein, 14 aa, Homo sapiens
SRDLLLFPQAPLTF

SEQ ID NO: 2703 - protein, 14 aa, Homo sapiens
SRYLLLFPQHGFDA

SEQ ID NO: 2704 - protein, 14 aa, Homo sapiens
SRDLLLFPSSHLSF

SEQ ID NO: 2705 - protein, 14 aa, Homo sapiens
SRDLLLFPQAPLTN

SEQ ID NO: 2706 - protein, 14 aa, Homo sapiens
SRDLLLFPHDPLYF

SEQ ID NO: 2707 - protein, 14 aa, Homo sapiens
SRDLLLFPSSPLAF

SEQ ID NO: 2708 - protein, 14 aa, Homo sapiens
SRDLLLFPQDPLVF

SEQ ID NO: 2709 - protein, 14 aa, Homo sapiens
SRDLLLFPSAPLNP

SEQ ID NO: 2710 - protein, 14 aa, Homo sapiens
SRDLLLFPYSPLYP

SEQ ID NO: 2711 - protein, 14 aa, Homo sapiens
SRDLLLFPSSPLEF

SEQ ID NO: 2712 - protein, 14 aa, Homo sapiens
SRDLLLFPSSPLIF

SEQ ID NO: 2713 - protein, 14 aa, Homo sapiens
SRDLLLFPSSPLLF

SEQ ID NO: 2714 - protein, 14 aa, Homo sapiens
SRDLLLFPSSPLRI

SEQ ID NO: 2715 - protein, 14 aa, Homo sapiens
SRDLLLFPSSPLSF

SEQ ID NO: 2716 - protein, 14 aa, Homo sapiens
SRDLLLFPSSPLSN

SEQ ID NO: 2717 - protein, 14 aa, Homo sapiens
SRDLLLFPSSPLSP

SEQ ID NO: 2718 - protein, 14 aa, Homo sapiens
SRDLLLFPSSPLTF

SEQ ID NO: 2719 - protein, 14 aa, Homo sapiens
SRDLLLFPYSPLRF

SEQ ID NO: 2720 - protein, 14 aa, Homo sapiens
SRDLLLFPSSPLYF

SEQ ID NO: 2721 - protein, 14 aa, Homo sapiens
SRDLLLFPRTPLVF

SEQ ID NO: 2722 - protein, 14 aa, Homo sapiens
SRDLLLFPSSALRF

SEQ ID NO: 2723 - protein, 14 aa, Homo sapiens
SRDLLLFPSSPLVF

SEQ ID NO: 2724 - protein, 14 aa, Homo sapiens
SRDLLLFPYDPLFM

SEQ ID NO: 2725 - protein, 15 aa, Homo sapiens
RDYDILTGYSRGFDP

SEQ ID NO: 2726 - protein, 18 aa, Homo sapiens
DIKRYNSNWPYYDYYMDV

SEQ ID NO: 2727 - protein, 19 aa, Homo sapiens
HVRDYDILTGYYRGHHFDY

SEQ ID NO: 2728 - protein, 16 aa, Homo sapiens
DHYDVLTGSYLQAFDV

SEQ ID NO: 2729 - protein, 24 aa, Homo sapiens
GPRGGPYYDILTGYYLSLSDAFDI

SEQ ID NO: 2730 - protein, 15 aa, Homo sapiens
VHYDILTGYLWAFDI

SEQ ID NO: 2731 - protein, 15 aa, Homo sapiens
GRYDFLTGYLRNFDY

SEQ ID NO: 2732 - protein, 16 aa, Homo sapiens
VSGYNSGYFESYDMDV

SEQ ID NO: 2733 - protein, 18 aa, Homo sapiens
GSVYDILTGTYYKSGMGV

SEQ ID NO: 2734 - protein, 15 aa, Homo sapiens
FRYDILTSYYYGMDV

SEQ ID NO: 2735 - protein, 19 aa, Homo sapiens
DKAHGEYGRDYYYYYGMDV

SEQ ID NO: 2736 - protein, 18 aa, Homo sapiens
ETRKYTSSPPYNYYYMDV

SEQ ID NO: 2737 - protein, 15 aa, Homo sapiens
ENYDILTGYYNFFDY

SEQ ID NO: 2738 - protein, 16 aa, Homo sapiens
GDYDILTGYPLHAFDI

SEQ ID NO: 2739 - protein, 15 aa, Homo sapiens
DRADILTGYNDAFDI

SEQ ID NO: 2740 - protein, 8 aa, Homo sapiens
PSYHYMDV

SEQ ID NO: 2741 - protein, 16 aa, Homo sapiens
DFYDILTGYPLGGMDV

SEQ ID NO: 2742 - protein, 15 aa, Homo sapiens
GDYDVLTGYLRKLDY

SEQ ID NO: 2743 - protein, 20 aa, Homo sapiens
EESYYDILTGYYVHYYGMDV

SEQ ID NO: 2744 - protein, 18 aa, Homo sapiens
GGYYDILTGYLVYYGMDV

SEQ ID NO: 2745 - protein, 16 aa, Homo sapiens
DSYDILTGYRGYYFDY

SEQ ID NO: 2746 - protein, 16 aa, Homo sapiens
SHYDILTGLNYWYFDY

SEQ ID NO: 2747 - protein, 20 aa, Homo sapiens
EGAHYDILTGHNYYHYGMDV

SEQ ID NO: 2748 - protein, 18 aa, Homo sapiens
ATKSYDILTRMYYYHMDV

SEQ ID NO: 2749 - protein, 10 aa, Homo sapiens
GPGVIGNYDY

SEQ ID NO: 2750 - protein, 13 aa, Homo sapiens
TRMDVLTRYYSDF

SEQ ID NO: 2751 - protein, 19 aa, Homo sapiens
EVRNYDLLTRSYLAGPLDN

SEQ ID NO: 2752 - protein, 18 aa, Homo sapiens
ENGDYDILTGQTFYGMDV

SEQ ID NO: 2753 - protein, 19 aa, Homo sapiens
EGYDILTGYFLDYYHGMDV

SEQ ID NO: 2754 - protein, 13 aa, Homo sapiens
HSKEYNWNYALDY

SEQ ID NO: 2755 - protein, 14 aa, Homo sapiens
RYGDPFYYYYYMNV

SEQ ID NO: 2756 - protein, 14 aa, Homo sapiens
RFYDLLTGYSAFDS

SEQ ID NO: 2757 - protein, 15 aa, Homo sapiens
AGYDLLTGYPFYFDS

SEQ ID NO: 2758 - protein, 18 aa, Homo sapiens
SDDYDILTGNYVGSLLDY

SEQ ID NO: 2759 - protein, 19 aa, Homo sapiens
GSLYYDILTGYYIGNAFDI

SEQ ID NO: 2760 - protein, 16 aa, Homo sapiens
DHYDILTGLYYYGMDV

SEQ ID NO: 2761 - protein, 22 aa, Homo sapiens
DRGSYDILTGYYTPPHYYGMDV

SEQ ID NO: 2762 - protein, 18 aa, Homo sapiens
ADYDILTGYSPLTYGMDV

SEQ ID NO: 2763 - protein, 21 aa, Homo sapiens
EDATYYDILTGYYMGSYGMDV

SEQ ID NO: 2764 - protein, 16 aa, Homo sapiens
GGYDILTQYPAEFFHP

SEQ ID NO: 2765 - protein, 15 aa, Homo sapiens
ARRVGVLGGKNAFEI

SEQ ID NO: 2766 - protein, 18 aa, Homo sapiens
GSGYDLLTGYFTGSPLDY

SEQ ID NO: 2767 - protein, 20 aa, Homo sapiens
QKVYYDILTGYNYYYYGMDV

SEQ ID NO: 2768 - protein, 14 aa, Homo sapiens
EGAADYLNGQYFQD

SEQ ID NO: 2769 - protein, 21 aa, Homo sapiens
NGYYDILTGYYLWDYYYGMDV

SEQ ID NO: 2770 - protein, 18 aa, Homo sapiens
HRSRSCSSTSCRNDAFDI

SEQ ID NO: 2771 - protein, 16 aa, Homo sapiens
AYYDILTGFLPYDMDL

SEQ ID NO: 2772 - protein, 15 aa, Homo sapiens
ENYDFLTGYYGAFDI

SEQ ID NO: 2773 - protein, 12 aa, Homo sapiens
AGSSLMTYGTDV

SEQ ID NO: 2774 - protein, 17 aa, Homo sapiens
GTYYDILTGYFHYGMDV

SEQ ID NO: 2775 - protein, 19 aa, Homo sapiens
DGIYDILTTLVSYYNGMDV

SEQ ID NO: 2776 - protein, 19 aa, Homo sapiens
DKTLGDQLVEAYYYDGMDV

SEQ ID NO: 2777 - protein, 13 aa, Homo sapiens
DFGVIGDYRPFDY

SEQ ID NO: 2778 - protein, 18 aa, Homo sapiens
EVRDYDILTGYYISYMDV

SEQ ID NO: 2779 - protein, 8 aa, Homo sapiens
DQRKAQDI

SEQ ID NO: 2780 - protein, 16 aa, Homo sapiens
ATHDPLTGYSFDGFDI

SEQ ID NO: 2781 - protein, 13 aa, Homo sapiens
GDYDILTGYYMDV

SEQ ID NO: 2782 - protein, 15 aa, Homo sapiens
TNYDILTGYYQGVDY

SEQ ID NO: 2783 - protein, 16 aa, Homo sapiens
AAYDPLTGYSFDGFDI

SEQ ID NO: 2784 - protein, 19 aa, Homo sapiens
ERHYYDILTGYQTGYGMDV

SEQ ID NO: 2785 - protein, 16 aa, Homo sapiens
RSMIVVTTAPYDAFDL

SEQ ID NO: 2786 - protein, 15 aa, Homo sapiens
MNYDILTGLVNWFDP

SEQ ID NO: 2787 - protein, 17 aa, Homo sapiens
GGELVWFGESDYYGMDV

SEQ ID NO: 2788 - protein, 13 aa, Homo sapiens
TYYDILTGYHFDY

SEQ ID NO: 2789 - protein, 20 aa, Homo sapiens
GLRHVTLFGTGTRGHFYMDV

SEQ ID NO: 2790 - protein, 17 aa, Homo sapiens
GLYFEDTNYRHGDAFDI

SEQ ID NO: 2791 - protein, 16 aa, Homo sapiens
VYYDILTGHPTYGMDV

SEQ ID NO: 2792 - protein, 16 aa, Homo sapiens
GDYDILTGYYIPLRDY

SEQ ID NO: 2793 - protein, 19 aa, Homo sapiens
GPWYDPLFPPSGRHYGLDV

SEQ ID NO: 2794 - protein, 14 aa, Homo sapiens
DIDARLAALDAFDI

SEQ ID NO: 2795 - protein, 18 aa, Homo sapiens
DVSGHDILTGYSYRYFDV

SEQ ID NO: 2796 - protein, 14 aa, Homo sapiens
GGHTCIIPTCHMGG

SEQ ID NO: 2797 - protein, 14 aa, Homo sapiens
SGEPCITLACNLGG

SEQ ID NO: 2798 - protein, 19 aa, Homo sapiens
ERPYYDILTGYTVTYGMDV

SEQ ID NO: 2799 - protein, 16 aa, Homo sapiens
LDYDILTGYYPSGFDY

SEQ ID NO: 2800 - protein, 18 aa, Homo sapiens
GTGYDILTGYYMGSAFDQ

SEQ ID NO: 2801 - protein, 18 aa, Homo sapiens
GPRYYDILTGYRYNWFDP

SEQ ID NO: 2802 - protein, 18 aa, Homo sapiens
ERADYDILTGYYFYGMDV

SEQ ID NO: 2803 - protein, 15 aa, Homo sapiens
DDYDILTGSLYYFDS

SEQ ID NO: 2804 - protein, 10 aa, Homo sapiens
DTVRSGGMDV

SEQ ID NO: 2805 - protein, 18 aa, Homo sapiens
VGLYYDILTGYYPSGMDV

SEQ ID NO: 2806 - protein, 16 aa, Homo sapiens
PYYDPLTAYTFQYFGN

SEQ ID NO: 2807 - protein, 22 aa, Homo sapiens
GREDTDKVKLWDRYYHYYYMDV

SEQ ID NO: 2808 - protein, 20 aa, Homo sapiens
KQRGDYDILTGYQLGYAFDI

SEQ ID NO: 2809 - protein, 22 aa, Homo sapiens
GREDTDKVKPWDRYYHYYYMDV

SEQ ID NO: 2810 - protein, 18 aa, Homo sapiens
IRLYCYSLTGYYPYGMDD

SEQ ID NO: 2811 - protein, 19 aa, Homo sapiens
GRRYDILTGYYYYHHGMDV

SEQ ID NO: 2812 - protein, 15 aa, Homo sapiens
SDYDILTGYYWVPAV

SEQ ID NO: 2813 - protein, 22 aa, Homo sapiens
GRKDTDKVKPWDRYYHYYYMDV

SEQ ID NO: 2814 - protein, 17 aa, Homo sapiens
TDRFGAKDVTSRWGMDV

SEQ ID NO: 2815 - protein, 14 aa, Homo sapiens
EGAADYLNGQYFQH

SEQ ID NO: 2816 - protein, 22 aa, Homo sapiens
SSPPKWYDALTGDSSYHSAMGV

SEQ ID NO: 2817 - protein, 17 aa, Homo sapiens
VSRDILTGNYYYYGMDV

SEQ ID NO: 2818 - protein, 22 aa, Homo sapiens
SSPPKWYDALTGDSSYRSAMDV

SEQ ID NO: 2819 - protein, 20 aa, Homo sapiens
VNADYDILTGYPRDYYGMDV

SEQ ID NO: 2820 - protein, 19 aa, Homo sapiens
VRPKLRYFDWLSRHDAFDL

SEQ ID NO: 2821 - protein, 15 aa, Homo sapiens
GYDDILTGYIMALDY

SEQ ID NO: 2822 - protein, 18 aa, Homo sapiens
ESTYDILTGSYHDYGLDV

SEQ ID NO: 2823 - protein, 12 aa, Homo sapiens
DMKVYYKYALDV

SEQ ID NO: 2824 - protein, 17 aa, Homo sapiens
GGNYDILTGYYIGAFDI

SEQ ID NO: 2825 - protein, 12 aa, Homo sapiens
AGSSLVTYGTDV

SEQ ID NO: 2826 - protein, 16 aa, Homo sapiens
DPFGAVPGYYYYAMDV

SEQ ID NO: 2827 - protein, 15 aa, Homo sapiens
VPYDILTGYWGAFDV

SEQ ID NO: 2828 - protein, 18 aa, Homo sapiens
DQQYDILTGYHIDYYMDV

SEQ ID NO: 2829 - protein, 16 aa, Homo sapiens
DYYDVLTGFSLDGMDV

SEQ ID NO: 2830 - protein, 19 aa, Homo sapiens
GRNYYDFLTGYNFNLGLDY

SEQ ID NO: 2831 - protein, 17 aa, Homo sapiens
MGHYDILTGYRHYGMDV

SEQ ID NO: 2832 - protein, 16 aa, Homo sapiens
VLNYDILTGYYYGMDV

SEQ ID NO: 2833 - protein, 18 aa, Homo sapiens
ERADYDILTGYYFYDMDV

SEQ ID NO: 2834 - protein, 19 aa, Homo sapiens
EQGYDILTGYYPEGGWFDP

SEQ ID NO: 2835 - protein, 22 aa, Homo sapiens
GREDTDKVKPWDRYFHYYYMDV

SEQ ID NO: 2836 - protein, 17 aa, Homo sapiens
ESGGYSYGSRDYYGMDV

SEQ ID NO: 2837 - protein, 19 aa, Homo sapiens
DRGYYDILTGYYRGHGMDV

SEQ ID NO: 2838 - protein, 16 aa, Homo sapiens
ELGHREGGYWYSPYNV

SEQ ID NO: 2839 - protein, 11 aa, Homo sapiens
QQWLPYDAFDI

SEQ ID NO: 2840 - protein, 22 aa, Homo sapiens
SNPPKWYDALTGHSSYHSAMDV

SEQ ID NO: 2841 - protein, 15 aa, Homo sapiens
EYYDVLTGLFYYMDV

SEQ ID NO: 2842 - protein, 8 aa, Homo sapiens
SQRLFIDS

SEQ ID NO: 2843 - protein, 20 aa, Homo sapiens
DPSPYYDILTGYFLPYYMDV

SEQ ID NO: 2844 - protein, 18 aa, Homo sapiens
GHYDILTGYDDYYYGMDV

SEQ ID NO: 2845 - protein, 24 aa, Homo sapiens
DQNHPIYDILTGYYVPTGPLELKN

SEQ ID NO: 2846 - protein, 18 aa, Homo sapiens
GIGYDLLTGYFTGSPLDY

SEQ ID NO: 2847 - protein, 17 aa, Homo sapiens
DSGGDILTGYYMPYFDY

SEQ ID NO: 2848 - protein, 22 aa, Homo sapiens
SGPPKWYDALTGHSSYHSAMDV

SEQ ID NO: 2849 - protein, 19 aa, Homo sapiens
VSPSYDILTGYYLPHAFDV

SEQ ID NO: 2850 - protein, 15 aa, Homo sapiens
PSYDILTGYLYYFDY

SEQ ID NO: 2851 - protein, 19 aa, Homo sapiens
GYEYYDILTGYNELGAFDI

SEQ ID NO: 2852 - protein, 16 aa, Homo sapiens
ELGSSIVGATTGALDM

SEQ ID NO: 2853 - protein, 16 aa, Homo sapiens
SYYDILTGYYHTPLDY

SEQ ID NO: 2854 - protein, 16 aa, Homo sapiens
GDYDILTGYPAECFQI

SEQ ID NO: 2855 - protein, 17 aa, Homo sapiens
ASYYDILTGYYKGAFDI

SEQ ID NO: 2856 - protein, 16 aa, Homo sapiens
TKYDILTGYYYYYMDV

SEQ ID NO: 2857 - protein, 15 aa, Homo sapiens
GQYYDILTGYNWFDP

SEQ ID NO: 2858 - protein, 15 aa, Homo sapiens
GRYYDMLTRGGYFDY

SEQ ID NO: 2859 - protein, 15 aa, Homo sapiens
GDYDILTGTYYYIDV

SEQ ID NO: 2860 - protein, 17 aa, Homo sapiens
GAYYDILTGYYPYGMDV

SEQ ID NO: 2861 - protein, 21 aa, Homo sapiens
DFGYYDILTGYYIGAFYAFDI

SEQ ID NO: 2862 - protein, 17 aa, Homo sapiens
EMGYDILTGYYLNYMDV

SEQ ID NO: 2863 - protein, 16 aa, Homo sapiens
THYDILTGYYSHPLDY

SEQ ID NO: 2864 - protein, 11 aa, Homo sapiens
SQWLEHDVFDI

SEQ ID NO: 2865 - protein, 21 aa, Homo sapiens
GGGYDILTGYSYPYLYYGLDV

SEQ ID NO: 2866 - protein, 13 aa, Homo sapiens
TYYDILTGRFFDI

SEQ ID NO: 2867 - protein, 13 aa, Homo sapiens
DVDDILTGYSWDY

SEQ ID NO: 2868 - protein, 16 aa, Homo sapiens
DDRDILTNYYLEYFQH

SEQ ID NO: 2869 - protein, 15 aa, Homo sapiens
VKRDILTGYVEGMDV

SEQ ID NO: 2870 - protein, 8 aa, Homo sapiens
SGPGWFDP

SEQ ID NO: 2871 - protein, 17 aa, Homo sapiens
AKGYYYDSSGASDVFDV

SEQ ID NO: 2872 - protein, 17 aa, Homo sapiens
GIYDILTGYHWDDAFDI

SEQ ID NO: 2873 - protein, 13 aa, Homo sapiens
AYYDILTGYFFDI

SEQ ID NO: 2874 - protein, 17 aa, Homo sapiens
TERFGAKDVTARWGMDV

SEQ ID NO: 2875 - protein, 20 aa, Homo sapiens
SQAHYDILTGYYLWSYGMDV

SEQ ID NO: 2876 - protein, 17 aa, Homo sapiens
DRGYDILTGYYYYGMDV

SEQ ID NO: 2877 - protein, 19 aa, Homo sapiens
AGGYYDILTGRDYYYGMDV

SEQ ID NO: 2878 - protein, 17 aa, Homo sapiens
DRRRDDLTGYLYDAFDS

SEQ ID NO: 2879 - protein, 13 aa, Homo sapiens
MYYDILTGHNFDY

SEQ ID NO: 2880 - protein, 18 aa, Homo sapiens
DMYYDILTGYYTGLAFDM

SEQ ID NO: 2881 - protein, 18 aa, Homo sapiens
GRGYDVLTGYFTGSPLDY

SEQ ID NO: 2882 - protein, 16 aa, Homo sapiens
LYYDILTGYHWDAFDI

SEQ ID NO: 2883 - protein, 15 aa, Homo sapiens
DEYDILTGLLQGMDV

SEQ ID NO: 2884 - protein, 12 aa, Homo sapiens
GGSSQNFYGMDV

SEQ ID NO: 2885 - protein, 19 aa, Homo sapiens
DRLHYDILTGHQTDDAFDI

SEQ ID NO: 2886 - protein, 15 aa, Homo sapiens
GHYDILTGYYFGFDY

SEQ ID NO: 2887 - protein, 21 aa, Homo sapiens
DRYYDILTGYYIPGLDDAFDI

SEQ ID NO: 2888 - protein, 23 aa, Homo sapiens
DASEYYDILTGYYLATGRNWFDP

SEQ ID NO: 2889 - protein, 19 aa, Homo sapiens
DKQYYDILTGDPVEGGMDV

SEQ ID NO: 2890 - protein, 16 aa, Homo sapiens
DLRYDILTGYHDAFDI

SEQ ID NO: 2891 - protein, 16 aa, Homo sapiens
ESYDILTGYRHYGMDL

SEQ ID NO: 2892 - protein, 17 aa, Homo sapiens
GIYDILTGYHWDGAFDI

SEQ ID NO: 2893 - protein, 16 aa, Homo sapiens
EGRDILTGVYYYGLDV

SEQ ID NO: 2894 - protein, 15 aa, Homo sapiens
DQHDILTGGYYGMDV

SEQ ID NO: 2895 - protein, 16 aa, Homo sapiens
AYDYDILTGYSYYFDY

SEQ ID NO: 2896 - protein, 20 aa, Homo sapiens
EGGNYHILTGYYIGNGAFDI

SEQ ID NO: 2897 - protein, 18 aa, Homo sapiens
GTGYDILTGYYMGSVFDP

SEQ ID NO: 2898 - protein, 15 aa, Homo sapiens
ERGSYSSGYSGAFDV

SEQ ID NO: 2899 - protein, 19 aa, Homo sapiens
DGYYDILTGGFYYYYGMDV

SEQ ID NO: 2900 - protein, 20 aa, Homo sapiens
DRGVGYDILTGRTYYYGMDV

SEQ ID NO: 2901 - protein, 21 aa, Homo sapiens
DDRRGYYDILTGYYRFGSFDI

SEQ ID NO: 2902 - protein, 17 aa, Homo sapiens
GRRYDILTGYYKGPLDY

SEQ ID NO: 2903 - protein, 20 aa, Homo sapiens
EGENYDILTGYYIGNGAFDI

SEQ ID NO: 2904 - protein, 9 aa, Homo sapiens
HDILTGFDY

SEQ ID NO: 2905 - protein, 13 aa, Homo sapiens
EIDDILTGYYMDV

SEQ ID NO: 2906 - protein, 15 aa, Homo sapiens
EGYDILTGYSKFLDY

SEQ ID NO: 2907 - protein, 16 aa, Homo sapiens
EHYDILTGYSLLGMDV

SEQ ID NO: 2908 - protein, 15 aa, Homo sapiens
GDYDILTGYYSHFDY

SEQ ID NO: 2909 - protein, 15 aa, Homo sapiens
HDYYIMTAAHYYYDS

SEQ ID NO: 2910 - protein, 15 aa, Homo sapiens
DFYDILTGYHDAFDI

SEQ ID NO: 2911 - protein, 19 aa, Homo sapiens
AFEDYDILTGYYHHDAFDI

SEQ ID NO: 2912 - protein, 22 aa, Homo sapiens
DGRLSYDILTGYYARDYYGMDV

SEQ ID NO: 2913 - protein, 14 aa, Homo sapiens
DRRDILTGSNFGQD

SEQ ID NO: 2914 - protein, 20 aa, Homo sapiens
DRGGNYDILTGYYFHHGVDV

SEQ ID NO: 2915 - protein, 19 aa, Homo sapiens
DGTYYDILTGYYNQYGMDV

SEQ ID NO: 2916 - protein, 14 aa, Homo sapiens
GQKNYYESSGYLEH

SEQ ID NO: 2917 - protein, 18 aa, Homo sapiens
DMHYDILTGYYTGLAFDM

SEQ ID NO: 2918 - protein, 16 aa, Homo sapiens
DQVDLLLMDHNYYMDV

SEQ ID NO: 2919 - protein, 15 aa, Homo sapiens
DFYDILTGYQHGMDV

SEQ ID NO: 2920 - protein, 7 aa, Homo sapiens
RRYALDY

SEQ ID NO: 2921 - protein, 15 aa, Homo sapiens
DQHDILTGVYYGMDV

SEQ ID NO: 2922 - protein, 19 aa, Homo sapiens
DPGYYDILTGYFHRYGMDV

SEQ ID NO: 2923 - protein, 19 aa, Homo sapiens
DLPYYDILTGYSLTSGMDV

SEQ ID NO: 2924 - protein, 15 aa, Homo sapiens
DIDDILTGYVLGMDV

SEQ ID NO: 2925 - protein, 17 aa, Homo sapiens
PQGVTLVRGAETDAFAI

SEQ ID NO: 2926 - protein, 24 aa, Homo sapiens
DYPGSEYDILTGYLFGYYYYGMDV

SEQ ID NO: 2927 - protein, 16 aa, Homo sapiens
GYYDILTGYQSDAFDI

SEQ ID NO: 2928 - protein, 19 aa, Homo sapiens
DRRDYDLLTRYYYYYGMDV

SEQ ID NO: 2929 - protein, 17 aa, Homo sapiens
PLGITAVRGAKTDAFGI

SEQ ID NO: 2930 - protein, 16 aa, Homo sapiens
HRRARVVVPVPGAMDV

SEQ ID NO: 2931 - protein, 18 aa, Homo sapiens
DRGYTGYDRLVGGYYFDF

SEQ ID NO: 2932 - protein, 16 aa, Homo sapiens
TYYDILTGYYAEYFQH

SEQ ID NO: 2933 - protein, 10 aa, Homo sapiens
RDILTGFYDS

SEQ ID NO: 2934 - protein, 15 aa, Homo sapiens
SGYDILTGYLYGMDV

SEQ ID NO: 2935 - protein, 19 aa, Homo sapiens
DPGNYDILTGYYYYYGMDV

SEQ ID NO: 2936 - protein, 19 aa, Homo sapiens
EGTYYDILTGYYPLGYFDY

SEQ ID NO: 2937 - protein, 17 aa, Homo sapiens
GVVWVAYGDVGIYGFDV

SEQ ID NO: 2938 - protein, 18 aa, Homo sapiens
DGYYDILTGYSVYYGMDV

SEQ ID NO: 2939 - protein, 19 aa, Homo sapiens
VLTNYDILTGYYREDAFDM

SEQ ID NO: 2940 - protein, 18 aa, Homo sapiens
TESNYDILTGYYWPSMDV

SEQ ID NO: 2941 - protein, 15 aa, Homo sapiens
GDYDPLTGYSFGVDV

SEQ ID NO: 2942 - protein, 15 aa, Homo sapiens
DNYDILTGYSRRFDP

SEQ ID NO: 2943 - protein, 15 aa, Homo sapiens
GQFGVLPNYYYHMDV

SEQ ID NO: 2944 - protein, 19 aa, Homo sapiens
LGRTSRDLLTGYHFYNMDV

SEQ ID NO: 2945 - protein, 12 aa, Homo sapiens
DRETKVGYGMDV

SEQ ID NO: 2946 - protein, 16 aa, Homo sapiens
DMGYDILTGYYGAFDI

SEQ ID NO: 2947 - protein, 16 aa, Homo sapiens
AYYDNLTGFLPYGMGV

SEQ ID NO: 2948 - protein, 16 aa, Homo sapiens
GERDILTGYYLDGMDV

SEQ ID NO: 2949 - protein, 16 aa, Homo sapiens
ATYDPLTGYYFDGFDI

SEQ ID NO: 2950 - protein, 16 aa, Homo sapiens
SHYDILTRLNYWYFDL

SEQ ID NO: 2951 - protein, 8 aa, Homo sapiens
GYDTAMQY

SEQ ID NO: 2952 - protein, 16 aa, Homo sapiens
LNLEKTVVRGFGYFDL

SEQ ID NO: 2953 - protein, 20 aa, Homo sapiens
LKAPYYDLLTGYHLPKWFDT

SEQ ID NO: 2954 - protein, 9 aa, Homo sapiens
DIDIGGDDS

SEQ ID NO: 2955 - protein, 17 aa, Homo sapiens
VSNDILTGWGGYNWFDP

SEQ ID NO: 2956 - protein, 19 aa, Homo sapiens
ERSQFDFLTGVDRYHPMDV

SEQ ID NO: 2957 - protein, 10 aa, Homo sapiens
SSNPVYGLDV

SEQ ID NO: 2958 - protein, 15 aa, Homo sapiens
RQYDILTGYYGGFDY

SEQ ID NO: 2959 - protein, 9 aa, Homo sapiens
GLGHTDSDS

SEQ ID NO: 2960 - protein, 17 aa, Homo sapiens
DREYDLLTGYYLHAFDM

SEQ ID NO: 2961 - protein, 20 aa, Homo sapiens
AGSGFHDILTGYYKGGYFDY

SEQ ID NO: 2962 - protein, 19 aa, Homo sapiens
GGPHYDILTGYYMAVGFDI

SEQ ID NO: 2963 - protein, 21 aa, Homo sapiens
DLGSFYDILTALRLENYGMDV

SEQ ID NO: 2964 - protein, 18 aa, Homo sapiens
DQQYDILTGYYIHYGMDV

SEQ ID NO: 2965 - protein, 16 aa, Homo sapiens
NLFDVWTLPYYYYMDV

SEQ ID NO: 2966 - protein, 11 aa, Homo sapiens
AYYDILTGLDY

SEQ ID NO: 2967 - protein, 18 aa, Homo sapiens
GGYSSGWLRGGPYNWFDP

SEQ ID NO: 2968 - protein, 17 aa, Homo sapiens
APYDILTGYSDYYGMDV

SEQ ID NO: 2969 - protein, 24 aa, Homo sapiens
DRGASNYDILTGYYAPAQGVAFDI

SEQ ID NO: 2970 - protein, 15 aa, Homo sapiens
AVLRYSAGLQGAFDI

SEQ ID NO: 2971 - protein, 15 aa, Homo sapiens
ENYDSLTGYYNYFDY

SEQ ID NO: 2972 - protein, 21 aa, Homo sapiens
GREDTDKVKPWDRYYHYYMDV

SEQ ID NO: 2973 - protein, 17 aa, Homo sapiens
EYYDILTGYRDPYGMDV

SEQ ID NO: 2974 - protein, 19 aa, Homo sapiens
EEGFYDILTGYYGPGYFDY

SEQ ID NO: 2975 - protein, 15 aa, Homo sapiens
DYYDILTKLPYGMDV

SEQ ID NO: 2976 - protein, 15 aa, Homo sapiens
DGYDILTGYYFGMDV

SEQ ID NO: 2977 - protein, 16 aa, Homo sapiens
ATQDILTGYLYSGMDV

SEQ ID NO: 2978 - protein, 14 aa, Homo sapiens
DSDARLAALDAFDI

SEQ ID NO: 2979 - protein, 17 aa, Homo sapiens
TDRFGAKDVTARWGMDV

SEQ ID NO: 2980 - protein, 16 aa, Homo sapiens
ELGLSIVVATTGALDM

SEQ ID NO: 2981 - protein, 9 aa, Homo sapiens
EGSSGYLVG

SEQ ID NO: 2982 - protein, 8 aa, Homo sapiens
DWGHWFDP

SEQ ID NO: 2983 - protein, 15 aa, Homo sapiens
FRYDILTGYYYDMDV

SEQ ID NO: 2984 - protein, 15 aa, Homo sapiens
EYYDILTGYSGAFDI

SEQ ID NO: 2985 - protein, 15 aa, Homo sapiens
ERGVVTAYGGDSFDL

SEQ ID NO: 2986 - protein, 21 aa, Homo sapiens
DAGESYDILTGYYVIEGYMDV

SEQ ID NO: 2987 - protein, 19 aa, Homo sapiens
DGGGYDILTGYQYYYGMDV

SEQ ID NO: 2988 - protein, 22 aa, Homo sapiens
DTLGYDILTGYPPPYYYYDMDV

SEQ ID NO: 2989 - protein, 17 aa, Homo sapiens
SYYDILTGRPYTDAFDI

SEQ ID NO: 2990 - protein, 13 aa, Homo sapiens
GGVTAGRSVYFDS

SEQ ID NO: 2991 - protein, 13 aa, Homo sapiens
ESEGGDYTNPFGY

SEQ ID NO: 2992 - protein, 16 aa, Homo sapiens
GPYDVLTGYLSGNFDY

SEQ ID NO: 2993 - protein, 21 aa, Homo sapiens
ECSGSSCPARQPPYYQYYMDV

SEQ ID NO: 2994 - protein, 18 aa, Homo sapiens
ESHYDILTGYYSNPSFDI

SEQ ID NO: 2995 - protein, 15 aa, Homo sapiens
ENYDYLTGYYGAFDI

SEQ ID NO: 2996 - protein, 19 aa, Homo sapiens
DYRNYDILTGHPYYYGMDV

SEQ ID NO: 2997 - protein, 17 aa, Homo sapiens
VGGYDILTGYYLRGMDV

SEQ ID NO: 2998 - protein, 16 aa, Homo sapiens
GPYDILTGYYRDAFDI

SEQ ID NO: 2999 - protein, 19 aa, Homo sapiens
DLWYYDILTGYYLDDAFDI

SEQ ID NO: 3000 - protein, 18 aa, Homo sapiens
VLPHYDILTGYSQNWFDP

SEQ ID NO: 3001 - protein, 12 aa, Homo sapiens
QGGQYDSPPFDV

SEQ ID NO: 3002 - protein, 12 aa, Homo sapiens
QGGQYDSPPLDV

SEQ ID NO: 3003 - protein, 16 aa, Homo sapiens
ATYDPLTGYSLDGFDI

SEQ ID NO: 3004 - protein, 16 aa, Homo sapiens
SYYDILTGYYPFGMDV

SEQ ID NO: 3005 - protein, 16 aa, Homo sapiens
GPSSAGTTIGLGSFDP

SEQ ID NO: 3006 - protein, 16 aa, Homo sapiens
GYHDTLTSYNYNWFDP

SEQ ID NO: 3007 - protein, 11 aa, Homo sapiens
EGSWSGLDLDY

SEQ ID NO: 3008 - protein, 9 aa, Homo sapiens
GMGDHYMDV

SEQ ID NO: 3009 - protein, 20 aa, Homo sapiens
GRRYYDILTGYSLGRGEMDV

SEQ ID NO: 3010 - protein, 21 aa, Homo sapiens
VPYYYDTSGGYLGEYYYGMDV

SEQ ID NO: 3011 - protein, 18 aa, Homo sapiens
SPEGDYQPLSSNYNWLDP

SEQ ID NO: 3012 - protein, 20 aa, Homo sapiens
ESGRYDILTGYYSGGGGMDV

SEQ ID NO: 3013 - protein, 18 aa, Homo sapiens
DYPIDVLTGRRTKNWFDP

SEQ ID NO: 3014 - protein, 25 aa, Homo sapiens
GPSTTYYDILTGYYTPYYYYYYMDV

SEQ ID NO: 3015 - protein, 12 aa, Homo sapiens
SGSSLMTYGTDV

SEQ ID NO: 3016 - protein, 12 aa, Homo sapiens
AGSSLMAYGTDV

SEQ ID NO: 3017 - protein, 21 aa, Homo sapiens
WATYYDTLTGYRLKDHAGFDI

SEQ ID NO: 3018 - protein, 16 aa, Homo sapiens
RYSDALTGYSLGAFDV

SEQ ID NO: 3019 - protein, 17 aa, Homo sapiens
THYDILTGYYTADAFDI

SEQ ID NO: 3020 - protein, 11 aa, Homo sapiens
GSRVRGVTPDL

SEQ ID NO: 3021 - protein, 21 aa, Homo sapiens
ERSYYDILTGYSPRSKYGMDV

SEQ ID NO: 3022 - protein, 16 aa, Homo sapiens
QHYDILTGYSQEPFDI

SEQ ID NO: 3023 - protein, 16 aa, Homo sapiens
GEYDILTGYPYWYFDL

SEQ ID NO: 3024 - protein, 17 aa, Homo sapiens
TYYDILTGYSGGGAFDY

SEQ ID NO: 3025 - protein, 17 aa, Homo sapiens
ESSITVNPPYYFYGMDV

SEQ ID NO: 3026 - protein, 14 aa, Homo sapiens
PYYDILTGYFAFDI

SEQ ID NO: 3027 - protein, 14 aa, Homo sapiens
EFDQLLARGHGMDV

SEQ ID NO: 3028 - protein, 17 aa, Homo sapiens
APLYDILTGYYIGGNDY

SEQ ID NO: 3029 - protein, 15 aa, Homo sapiens
LGYYDILTGYRSDDY

SEQ ID NO: 3030 - protein, 16 aa, Homo sapiens
DAYYDILTGWVYGMDV

SEQ ID NO: 3031 - protein, 18 aa, Homo sapiens
GRHYYDILTGYYNEAFDI

SEQ ID NO: 3032 - protein, 17 aa, Homo sapiens
SPGDDILTGYYKYYFDY

SEQ ID NO: 3033 - protein, 13 aa, Homo sapiens
DRGPGLLSSFFES

SEQ ID NO: 3034 - protein, 16 aa, Homo sapiens
MEYDILTSYYGGYFDY

SEQ ID NO: 3035 - protein, 19 aa, Homo sapiens
GGLYDILTGRPATDDAFDI

SEQ ID NO: 3036 - protein, 19 aa, Homo sapiens
SPMYYDRLTGFYPSGYFDS

SEQ ID NO: 3037 - protein, 19 aa, Homo sapiens
GEGGYDILTGYLRGYGMDV

SEQ ID NO: 3038 - protein, 19 aa, Homo sapiens
SQSDYDILTGYYYYYGMDV

SEQ ID NO: 3039 - protein, 20 aa, Homo sapiens
DRLEYYDILTGYYYYYGMDV

SEQ ID NO: 3040 - protein, 18 aa, Homo sapiens
DKDYDILTGYWRDELLDY

SEQ ID NO: 3041 - protein, 16 aa, Homo sapiens
EPYDILTGYYGSYFDY

SEQ ID NO: 3042 - protein, 11 aa, Homo sapiens
KNMGASAAADF

SEQ ID NO: 3043 - protein, 21 aa, Homo sapiens
ARGSYDILTGYYRPGDGYFDY

SEQ ID NO: 3044 - protein, 21 aa, Homo sapiens
ESGSHYDLLTGLLVAANGFDV

SEQ ID NO: 3045 - protein, 24 aa, Homo sapiens
GEKARYYDILTGYYSAWGGYYMDV

SEQ ID NO: 3046 - protein, 15 aa, Homo sapiens
EKYDILTGYYDAFDI

SEQ ID NO: 3047 - protein, 16 aa, Homo sapiens
DQVDRLLMQYNYYMDA

SEQ ID NO: 3048 - protein, 12 aa, Homo sapiens
AGTSLMNYGTDV

SEQ ID NO: 3049 - protein, 15 aa, Homo sapiens
VNYDILTGLGYYFDY

SEQ ID NO: 3050 - protein, 18 aa, Homo sapiens
LPPYDMLTGYYVGGGMDV

SEQ ID NO: 3051 - protein, 15 aa, Homo sapiens
GYYDILTGYYDAFDI

SEQ ID NO: 3052 - protein, 19 aa, Homo sapiens
DKSYYDILTGYYYYYGMDV

SEQ ID NO: 3053 - protein, 20 aa, Homo sapiens
ERPGYDILTGYPSSIYGMDV

SEQ ID NO: 3054 - protein, 13 aa, Homo sapiens
DQFSVGGRHAFDL

SEQ ID NO: 3055 - protein, 19 aa, Homo sapiens
DVTYHDILTGYAGHEAFDI

SEQ ID NO: 3056 - protein, 13 aa, Homo sapiens
TYYDILTGYYFDY

SEQ ID NO: 3057 - protein, 18 aa, Homo sapiens
GSGYDVLTGYFTGSPLDY

SEQ ID NO: 3058 - protein, 16 aa, Homo sapiens
SPYDTLTGYVYNGVDV

SEQ ID NO: 3059 - protein, 17 aa, Homo sapiens
DGYYDILTGYSGYYMDV

SEQ ID NO: 3060 - protein, 18 aa, Homo sapiens
DRYYDILTKGDYYYGMDV

SEQ ID NO: 3061 - protein, 20 aa, Homo sapiens
DRGHYDILTGYYIEPSGFDY

SEQ ID NO: 3062 - protein, 17 aa, Homo sapiens
DPNYDILTGYYYYAMDV

SEQ ID NO: 3063 - protein, 17 aa, Homo sapiens
GSYYDILTGISSLGMDV

SEQ ID NO: 3064 - protein, 14 aa, Homo sapiens
YFDGSGYYPVSFSY

SEQ ID NO: 3065 - protein, 18 aa, Homo sapiens
AKPYTDFSRGSDADAFDV

SEQ ID NO: 3066 - protein, 15 aa, Homo sapiens
GRYDILTGYFTSFDY

SEQ ID NO: 3067 - protein, 19 aa, Homo sapiens
SQSNYDILTGYYYYYGMDV

SEQ ID NO: 3068 - protein, 21 aa, Homo sapiens
DEYYDILTGYQAPYYYYGMDV

SEQ ID NO: 3069 - protein, 25 aa, Homo sapiens
VQGETYYDILTGYWGPKRDLYGMDV

SEQ ID NO: 3070 - protein, 12 aa, Homo sapiens
AGTSLMNYGMDV

SEQ ID NO: 3071 - protein, 16 aa, Homo sapiens
VAAAGARTLGYFGMDV

SEQ ID NO: 3072 - protein, 21 aa, Homo sapiens
DGANYDILTGYYTTTVYGMDV

SEQ ID NO: 3073 - protein, 13 aa, Homo sapiens
QYYDILTGYELDI

SEQ ID NO: 3074 - protein, 17 aa, Homo sapiens
DRDYDILTDYSNYGMDV

SEQ ID NO: 3075 - protein, 12 aa, Homo sapiens
VRLPHHHYFMAV

SEQ ID NO: 3076 - protein, 23 aa, Homo sapiens
AQMDSEYYDLLTGINVGPYYFDY

SEQ ID NO: 3077 - protein, 15 aa, Homo sapiens
NYYDVLTQSYYGMDV

SEQ ID NO: 3078 - protein, 18 aa, Homo sapiens
VEGVYDILTGYSFDAFDI

SEQ ID NO: 3079 - protein, 12 aa, Homo sapiens
GYRNDWYGAFEI

SEQ ID NO: 3080 - protein, 17 aa, Homo sapiens
DTRVIGIQLWERGAFDM

SEQ ID NO: 3081 - protein, 16 aa, Homo sapiens
LNLEKTVIRGFGYFDL

SEQ ID NO: 3082 - protein, 21 aa, Homo sapiens
GDFGDYDILTGYYPVYYGMDV

SEQ ID NO: 3083 - protein, 15 aa, Homo sapiens
GGMIRAREDYYYMDV

SEQ ID NO: 3084 - protein, 8 aa, Homo sapiens
DNSGTYGY

SEQ ID NO: 3085 - protein, 15 aa, Homo sapiens
SPNGDYSGYAWGLEY

SEQ ID NO: 3086 - protein, 13 aa, Homo sapiens
GNYDILTGYPHDL

SEQ ID NO: 3087 - protein, 19 aa, Homo sapiens
DQTYYDILTGHYYYYGMDV

SEQ ID NO: 3088 - protein, 8 aa, Homo sapiens
RDVQGAPY

SEQ ID NO: 3089 - protein, 8 aa, Homo sapiens
GKEGYNDN

SEQ ID NO: 3090 - protein, 16 aa, Homo sapiens
RSYDILTGYYTYGMDV

SEQ ID NO: 3091 - protein, 13 aa, Homo sapiens
SGRQAYYYYGMDV

SEQ ID NO: 3092 - protein, 8 aa, Homo sapiens
TDYGGFDY

SEQ ID NO: 3093 - protein, 11 aa, Homo sapiens
EKRGSRRVFDI

SEQ ID NO: 3094 - protein, 6 aa, Homo sapiens
DTPLDP

SEQ ID NO: 3095 - protein, 15 aa, Homo sapiens
GRGYSSSSSVYGMDI

SEQ ID NO: 3096 - protein, 13 aa, Homo sapiens
VVGGYSSTLGTDV

SEQ ID NO: 3097 - protein, 10 aa, Homo sapiens
SRSPYDAFDI

SEQ ID NO: 3098 - protein, 8 aa, Homo sapiens
GHFYGMDV

SEQ ID NO: 3099 - protein, 11 aa, Homo sapiens
NSAPPAPSMDV

SEQ ID NO: 3100 - protein, 10 aa, Homo sapiens
KQRREKYFDY

SEQ ID NO: 3101 - protein, 18 aa, Homo sapiens
DGDISDSPINNQNYAMDI

SEQ ID NO: 3102 - protein, 12 aa, Homo sapiens
RPALRSLWYFDL

SEQ ID NO: 3103 - protein, 10 aa, Homo sapiens
EDLTGDAFDI

SEQ ID NO: 3104 - protein, 11 aa, Homo sapiens
ELTGANDAFDI

SEQ ID NO: 3105 - protein, 10 aa, Homo sapiens
DEIYNDAFDY

SEQ ID NO: 3106 - protein, 12 aa, Homo sapiens
LSNRNDNLRLDY

SEQ ID NO: 3107 - protein, 18 aa, Homo sapiens
ARDYYDSSGYYVPDAFDI

SEQ ID NO: 3108 - protein, 6 aa, Homo sapiens
DSGSPD

SEQ ID NO: 3109 - protein, 14 aa, Homo sapiens
NPYYYDSSEGFFDY

SEQ ID NO: 3110 - protein, 11 aa, Homo sapiens
DSRPTNRAFHY

SEQ ID NO: 3111 - protein, 8 aa, Homo sapiens
EHSSSFDY

SEQ ID NO: 3112 - protein, 11 aa, Homo sapiens
GSNYSPDAFDI

SEQ ID NO: 3113 - protein, 19 aa, Homo sapiens
DSDLVVIPTAIQGRYYFDN

SEQ ID NO: 3114 - protein, 10 aa, Homo sapiens
GPSYYYYMAV

SEQ ID NO: 3115 - protein, 15 aa, Homo sapiens
ESLLTEEYCGSDCYS

SEQ ID NO: 3116 - protein, 10 aa, Homo sapiens
ESLTGDAFDI

SEQ ID NO: 3117 - protein, 10 aa, Homo sapiens
ESLTGGAFDI

SEQ ID NO: 3118 - protein, 9 aa, Homo sapiens
GAGSRYFDL

SEQ ID NO: 3119 - protein, 8 aa, Homo sapiens
GGDRAFDI

SEQ ID NO: 3120 - protein, 11 aa, Homo sapiens
SPLHFSDAFDI

SEQ ID NO: 3121 - protein, 5 aa, Homo sapiens
NAFDY

SEQ ID NO: 3122 - protein, 5 aa, Homo sapiens
LSGDS

SEQ ID NO: 3123 - protein, 9 aa, Homo sapiens
EGVAAGEDY

SEQ ID NO: 3124 - protein, 11 aa, Homo sapiens
FPLESYYYMDV

SEQ ID NO: 3125 - protein, 14 aa, Homo sapiens
AVRSPGYYYYYMDV

SEQ ID NO: 3126 - protein, 17 aa, Homo sapiens
DADEGLVEAETTNWFDS

SEQ ID NO: 3127 - protein, 9 aa, Homo sapiens
DYPHNAFDI

SEQ ID NO: 3128 - protein, 14 aa, Homo sapiens
VEWEDIVVGSAFDI

SEQ ID NO: 3129 - protein, 14 aa, Homo sapiens
PAASSRGPKDAFDI

SEQ ID NO: 3130 - protein, 12 aa, Homo sapiens
GKRYSYGWYFDI

SEQ ID NO: 3131 - protein, 20 aa, Homo sapiens
DVRSDRFWSGGYFHYSGMDV

SEQ ID NO: 3132 - protein, 8 aa, Homo sapiens
VRPGLMDV

SEQ ID NO: 3133 - protein, 20 aa, Homo sapiens
DILPDYDFWNPNEDASSLDT

SEQ ID NO: 3134 - protein, 5 aa, Homo sapiens
DPFDY

SEQ ID NO: 3135 - protein, 6 aa, Homo sapiens
GNGKDV

SEQ ID NO: 3136 - protein, 18 aa, Homo sapiens
KRGDFGVIRLHHYYGMDV

SEQ ID NO: 3137 - protein, 9 aa, Homo sapiens
VGYGGKGDY

SEQ ID NO: 3138 - protein, 12 aa, Homo sapiens
VLVRGQYRGMDL

SEQ ID NO: 3139 - protein, 5 aa, Homo sapiens
RYYDY

SEQ ID NO: 3140 - protein, 16 aa, Homo sapiens
DGNLNYDGSTDYGMDV

SEQ ID NO: 3141 - protein, 8 aa, Homo sapiens
GRKPLFDY

SEQ ID NO: 3142 - protein, 8 aa, Homo sapiens
DAAVTAEG

SEQ ID NO: 3143 - protein, 11 aa, Homo sapiens
VNDIVVVDMDV

SEQ ID NO: 3144 - protein, 15 aa, Homo sapiens
VRQQIADPPRSFFDP

SEQ ID NO: 3145 - protein, 19 aa, Homo sapiens
VTSLYSSSSGGYYYYGMDV

SEQ ID NO: 3146 - protein, 11 aa, Homo sapiens
NITPLAMVGDF

SEQ ID NO: 3147 - protein, 7 aa, Homo sapiens
GDAYFDY

SEQ ID NO: 3148 - protein, 13 aa, Homo sapiens
ERGGRDGDYALDF

SEQ ID NO: 3149 - protein, 20 aa, Homo sapiens
GAHYYDRSPSHLKSYWYFDL

SEQ ID NO: 3150 - protein, 17 aa, Homo sapiens
EGSIVGATLTINDAFDI

SEQ ID NO: 3151 - protein, 17 aa, Homo sapiens
EKAIIETTSGEADPFDI

SEQ ID NO: 3152 - protein, 9 aa, Homo sapiens
TWATNTFDM

SEQ ID NO: 3153 - protein, 13 aa, Homo sapiens
DGPTYARPYYLDH

SEQ ID NO: 3154 - protein, 23 aa, Homo sapiens
DFQMVRGVFIANPPIYNYYGMDV

SEQ ID NO: 3155 - protein, 12 aa, Homo sapiens
EGDPTDNDAFDV

SEQ ID NO: 3156 - protein, 9 aa, Homo sapiens
ERGNQAFDI

SEQ ID NO: 3157 - protein, 8 aa, Homo sapiens
EVGGAFDI

SEQ ID NO: 3158 - protein, 10 aa, Homo sapiens
GNSFGRTLDY

SEQ ID NO: 3159 - protein, 15 aa, Homo sapiens
ALLGLPSDFSYYVDV

SEQ ID NO: 3160 - protein, 16 aa, Homo sapiens
EGEGDGYNVAPYYFDY

SEQ ID NO: 3161 - protein, 5 aa, Homo sapiens
LIEDF

SEQ ID NO: 3162 - protein, 12 aa, Homo sapiens
GGVGDSRGVFDP

SEQ ID NO: 3163 - protein, 21 aa, Homo sapiens
LPPDLRYCDGGICPGFDWLGP

SEQ ID NO: 3164 - protein, 11 aa, Homo sapiens
DLSRVAGRFDY

SEQ ID NO: 3165 - protein, 11 aa, Homo sapiens
EFFGYVYLTDY

SEQ ID NO: 3166 - protein, 11 aa, Homo sapiens
ADYSNDYYMDV

SEQ ID NO: 3167 - protein, 5 aa, Homo sapiens
FDLDY

SEQ ID NO: 3168 - protein, 5 aa, Homo sapiens
LLSDY

SEQ ID NO: 3169 - protein, 7 aa, Homo sapiens
GFALYKD

SEQ ID NO: 3170 - protein, 7 aa, Homo sapiens
RLIRKAR

SEQ ID NO: 3171 - protein, 9 aa, Homo sapiens
ASYPVPFDY

SEQ ID NO: 3172 - protein, 13 aa, Homo sapiens
VDYTDYEMGAFDL

SEQ ID NO: 3173 - protein, 10 aa, Homo sapiens
VRDDSAGFDY

SEQ ID NO: 3174 - protein, 5 aa, Homo sapiens
LAFDI

SEQ ID NO: 3175 - protein, 10 aa, Homo sapiens
TGIWGYYFDY

SEQ ID NO: 3176 - protein, 12 aa, Homo sapiens
GLDVYAIYGLDV

SEQ ID NO: 3177 - protein, 11 aa, Homo sapiens
GGDMTTVTTDY

SEQ ID NO: 3178 - protein, 10 aa, Homo sapiens
EIGWEGAFDI

SEQ ID NO: 3179 - protein, 8 aa, Homo sapiens
VKRYYFDY

SEQ ID NO: 3180 - protein, 10 aa, Homo sapiens
EAGEVAAIDY

SEQ ID NO: 3181 - protein, 13 aa, Homo sapiens
LGRNYTSSWSLDY

SEQ ID NO: 3182 - protein, 7 aa, Homo sapiens
DRTRMDV

SEQ ID NO: 3183 - protein, 9 aa, Homo sapiens
GGMDWDFDY

SEQ ID NO: 3184 - protein, 17 aa, Homo sapiens
GLAPIVDGGMTNDAFDI

SEQ ID NO: 3185 - protein, 11 aa, Homo sapiens
PYGSGSYAFDI

SEQ ID NO: 3186 - protein, 10 aa, Homo sapiens
LHCTGGSCGF

SEQ ID NO: 3187 - protein, 13 aa, Homo sapiens
VDYTDYEMGAFEI

SEQ ID NO: 3188 - protein, 16 aa, Homo sapiens
EAGGSGSYHFSFPFDY

SEQ ID NO: 3189 - protein, 12 aa, Homo sapiens
EAYASSWAEFDF

SEQ ID NO: 3190 - protein, 12 aa, Homo sapiens
EAYTSSWAEFDF

SEQ ID NO: 3191 - protein, 11 aa, Homo sapiens
ELVGAPGGFDP

SEQ ID NO: 3192 - protein, 11 aa, Homo sapiens
DVPPPDGYLEV

SEQ ID NO: 3193 - protein, 13 aa, Homo sapiens
DLSGSYFSRYFDY

SEQ ID NO: 3194 - protein, 13 aa, Homo sapiens
DRIAAAGGDAFDI

SEQ ID NO: 3195 - protein, 7 aa, Homo sapiens
GWRGVDY

SEQ ID NO: 3196 - protein, 10 aa, Homo sapiens
VGNFGYYFEY

SEQ ID NO: 3197 - protein, 12 aa, Homo sapiens
DLYKNGYALFDS

SEQ ID NO: 3198 - protein, 9 aa, Homo sapiens
SDDWGAYHI

SEQ ID NO: 3199 - protein, 12 aa, Homo sapiens
STLEVGATDFDY

SEQ ID NO: 3200 - protein, 9 aa, Homo sapiens
EGLLDAFDI

SEQ ID NO: 3201 - protein, 10 aa, Homo sapiens
DEYSSLYMDV

SEQ ID NO: 3202 - protein, 10 aa, Homo sapiens
SNWGGDAFDI

SEQ ID NO: 3203 - protein, 17 aa, Homo sapiens
ESSGTLGEFSLELPFDY

SEQ ID NO: 3204 - protein, 14 aa, Homo sapiens
TSERGTYRQWDFDN

SEQ ID NO: 3205 - protein, 10 aa, Homo sapiens
HDVYGDLFDS

SEQ ID NO: 3206 - protein, 12 aa, Homo sapiens
LGVARGREAFDL

SEQ ID NO: 3207 - protein, 10 aa, Homo sapiens
DQGIETANDY

SEQ ID NO: 3208 - protein, 10 aa, Homo sapiens
SVAGRGNFDY

SEQ ID NO: 3209 - protein, 13 aa, Homo sapiens
RGGTSENYSGMDV

SEQ ID NO: 3210 - protein, 6 aa, Homo sapiens
GGWLDD

SEQ ID NO: 3211 - protein, 10 aa, Homo sapiens
HDVYGDLFDY

SEQ ID NO: 3212 - protein, 16 aa, Homo sapiens
ETFSHCSGGSCYPFDY

SEQ ID NO: 3213 - protein, 9 aa, Homo sapiens
VDSSGYAYY

SEQ ID NO: 3214 - protein, 8 aa, Homo sapiens
SSRNGGDY

SEQ ID NO: 3215 - protein, 14 aa, Homo sapiens
RTPDHNGDSGPPDY

SEQ ID NO: 3216 - protein, 6 aa, Homo sapiens
VHSSGS

SEQ ID NO: 3217 - protein, 12 aa, Homo sapiens
GKRYSYGWYFDV

SEQ ID NO: 3218 - protein, 14 aa, Homo sapiens
LRPDADYGDYGFDY

SEQ ID NO: 3219 - protein, 21 aa, Homo sapiens
LPPDLRYCDGGMCSGFDWLGP

SEQ ID NO: 3220 - protein, 11 aa, Homo sapiens
DGTKYDWGFDY

SEQ ID NO: 3221 - protein, 10 aa, Homo sapiens
LHCSGGSCGF

SEQ ID NO: 3222 - protein, 18 aa, Homo sapiens
GPIYYFDGSAYEGYYFDY

SEQ ID NO: 3223 - protein, 8 aa, Homo sapiens
MNADAFEI

SEQ ID NO: 3224 - protein, 10 aa, Homo sapiens
FGAGRLYDDY

SEQ ID NO: 3225 - protein, 15 aa, Homo sapiens
AGGNPRSGSLVYFDY

SEQ ID NO: 3226 - protein, 19 aa, Homo sapiens
GGRYGYYYDGTGYVDAFDI

SEQ ID NO: 3227 - protein, 19 aa, Homo sapiens
DYYDGSSYSSGDYYYYMDV

SEQ ID NO: 3228 - protein, 285 aa, Homo sapiens
MDDSTEREQSRLTSCLKKREEMKLKECVSILPRKESPSVRSSKDGKLLAATLLLALLSCCLTVVSFYQVAALQGDLASLRAELQGHHAEKLPAGAGAPKAGLEEAPAVTAGLKIFEPPAPGEGNSSQNSRNKRAVQGPEETVTQDCLQLIADSETPTIQKGSYTFVPWLLSFKRGSALEEKENKILVKETGYFFIYGQVLYTDKTYAMGHLIQRKKVHVFGDELSLVTLFRCIQNMPETLPNNSCYSAGIAKLEEGDELQLAIPRENAQISLDGDVTFFGALKLL

SEQ ID NO: 3229 - protein, 266 aa, Human sapiens
MDDSTEREQSRLTSCLKKREEMKLKECVSILPRKESPSVRSSKDGKLLAATLLLALLSCCLTVVSFYQVAALQGDLASLRAELQGHHAEKLPAGAGAPKAGLEEAPAVTAGLKIFEPPAPGEGNSSQNSRNKRAVQGPEETGSYTFVPWLLSFKRGSALEEKENKILVKETGYFFIYGQVLYTDKTYAMGHLIQRKKVHVFGDELSLVTLFRCIQNMPETLPNNSCYSAGIAKLEEGDELQLAIPRENAQISLDGDVTFFGALKLL

SEQ ID NO: 3230 - protein, 309 aa, Mus musculus
MDESAKTLPPPCLCFCSEKGEDMKVGYDPITPQKEEGAWFGICRDGRLLAATLLLALLSSSFTAMSLYQLAALQADLMNLRMELQSYRGSATPAAAGAPELTAGVKLLTPAAPRPHNSSRGHRNRRAFQGPEETEQDVDLSAPPAPCLPGCRHSQHDDNGMNLRNIIQDCLQLIADSDTPTIRKGTYTFVPWLLSFKRGNALEEKENKIVVRQTGYFFIYSQVLYTDPIFAMGHVIQRKKVHVFGDELSLVTLFRCIQNMPKTLPNNSCYSAGIARLEEGDEIQLAIPRENAQISRNGDDTFFGALKLL

SEQ ID NO: 3231 - protein, 290 aa, Mus musculus
MDESAKTLPPPCLCFCSEKGEDMKVGYDPITPQKEEGAWFGICRDGRLLAATLLLALLSSSFTAMSLYQLAALQADLMNLRMELQSYRGSATPAAAGAPELTAGVKLLTPAAPRPHNSSRGHRNRRAFQGPEETEQDVDLSAPPAPCLPGCRHSQHDDNGMNLRNRTYTFVPWLLSFKRGNALEEKENKIVVRQTGYFFIYSQVLYTDPIFAMGHVIQRKKVHVFGDELSLVTLFRCIQNMPKTLPNNSCYSAGIARLEEGDEIQLAIPRENAQISRNGDDTFFGALKLL

SEQ ID NO: 3232 - protein, 239 aa, Rattus rattus
AVQADLMSLRMELQSYRSSATPAAPGAPGLSAGVKLPTPAAPGPHNSSRGQRNRRAFQGPEETEQDVDLSATPAPSLPGNCHASHHDENGLNLRTIIQDCLQLIADSNTPTIRKGTYTFVPWLLSFKRGNALEEKENKIVVRQTGYFFIYSQVLYTDPIFAMGHVIQRKKIHVFGDELSLVTLFRCIQNMPKTLPNNSCYSAGIAKLEEGDEIQLAIPRENAQISRNGDDTFFGALKLL

SEQ ID NO: 3233 - protein, 220 aa, Rattus rattus
AVQADLMSLRMELQSYRSSATPAAPGAPGLSAGVKLPTPAAPGPHNSSRGQRNRRAFQGPEETEQDVDLSATPVPSLPGNCHASHHDENGLNLRTRTYTFVPWLLSFKRGNALEEKENKIVVRQTGYFFIYSQVLYTDPIFAMGHVIQRKKIHVFGDELSLVTLFRCIQNMPKTLPNNSCYSAGIAKLEEGDEIQLAIPRENAQISRNGDDTFFGALKLL

SEQ ID NO: 3234 - protein, 207 aa, Rattus rattus
AVQADLMSLRMELQSYRSSATPAAPGAPGLSAGVKLPTPAAPGPHNSSRGQRNRRAFQGPEETVIQDCLQLIADSNTPTIRKGTYTFVPWLLSFKRGNALEEKENKIVVRQTGYFFIYSQVLYTDPIFAMGHVIQRKKIHVFGDELSLVTLFRCIQNMPKTLPNNSCYSAGIAKLEEGDEVQLAIPRENAQISRNGDDTFFGALKLL

SEQ ID NO: 3235 - protein, 188 aa, Rattus rattus
AVQADLMSLRMELQSYRSSATPAAPGAPGLSAGVKLPTPAAPGPHNSSRGQRNRRAFQGPEETGTYTFVPWLLSFKRGNALEEKENKIVVRQTGYFFIYSQVLYTDPIFAMGHVIQRKKIHVFGDELSLVTLFRCIQNMPKTLPNNSCYSAGIAKLEEGDEIQLAIPRENAQISRNGDDTFFGALKLL

SEQ ID NO: 3236 - protein, 243 aa, Macaca fascicularis
KDRKLLAAALLLALLSCCLMVVSFYQVAALQGDLASLRAELQGHHAEKLPARARAPKAGLGEAPAVTAGLKIFEPPAPGEGNSSQSSRNKRAIQGAEETVIQDCLQLIADSETPTIQKGSYTFVPWLLSFKRGSALEEKENKILVKETGYFFIYGQVLYTDKTYAMGHLIQRKKVHVFGDELSLVTLFRCIQNMPETLPNNSCYSAGIAKLEEGDELQLAIPRENAQISLDGDVTFFGALKLL

SEQ ID NO: 3237 - protein, 219 aa, Macaca mulatta
YQVAAVQGDLASLRAELQSHHAEKLPARARAPKAGLGEAPAVTAGLKIFEPPAPGEGNSSQSSRNKRAIQGAEETVIQDCLQLIADSETPTIQKGSYTFVPWLLSFKRGSALEEKENKILVKETGYFFIYGQVLYTDKTYAMGHLIQRKKVHVFGDELSLVTLFRCIQNMPETLPNNSCYSAGIAKLEEGDELQLAIPRENAQISLDGDVTFFGALKLL

SEQ ID NO: 3238 - protein, 8 aa, Artificial sequence
  site (1)..(8): Flag Tag
DYKDDDDK

SEQ ID NO: 3239 - protein, 250 aa, Homo sapiens [sequence omitted]

What is claimed is:

1. An isolated antibody that immunospecifically binds B Lymphocyte Stimulator protein wherein said antibody comprises a first amino acid sequence at least 85% identical to amino acid residues 1–123 of SEQ ID NO:327 and a second amino acid sequence at least 85% identical to amino acid residues 141–249 of SEQ ID NO:327 and wherein said B Lymphocyte Stimulator protein is selected from the group consisting of:

(a) a protein whose amino acid sequence consists of amino acid residues 1–285 of SEQ ID NO:3228;

(b) a protein whose amino acid sequence consists of amino acid residues 134–285 of SEQ ID NO:3228; and (c) a trimer of the protein of (b).

2. The antibody of claim 1 wherein the first amino acid sequence is at least 95% identical to amino acid residues 1–123 of SEQ ID NO:327 and the second amino acid sequence is at least 95% identical to amino acid residues 141–249 of SEQ ID NO:327.

3. The antibody of claim 1 wherein the amino acid differences between the first amino acid sequence and amino acid residues 1–123 of SEQ ID NO:327 are in one or more of the CDR regions located at amino acid residues 26–35, 50–66 and 99–112 of SEQ ID NO: 327 and wherein the amino acid differences between the second amino acid sequence and amino acid residues 141–249 of SEQ ID NO: 327 are in one or more of the CDR regions located at amino acid residues 163–173, 189–195 and 228–238 of SEQ ID NO: 327.

4. An isolated antibody that immunospecifically binds B Lymphocyte Stimulator protein wherein said antibody comprises amino acid residues 1–123 of SEQ ID NO: 327 and amino acid residues 141–249 of SEQ ID NO: 327 and wherein said B Lymphocyte Stimulator protein is selected from the group consisting of:

(a) a protein whose amino acid sequence consists of amino acid residues 1–285 of SEQ ID NO:3228;

(b) a protein whose amino acid sequence consists of amino acid residues 134–285 of SEQ ID NO:3228; and (c) a trimer of the protein of (b).

5. The antibody of claim 1 wherein the antibody is selected from the group consisting of:

(a) a whole immunoglobulin molecule;

(b) an scFv;

(c) a chimeric antibody;

(d) a Fab fragment;

(e) an Fab' fragment; and (f) an F(ab')2.

6. The antibody of claim 1 wherein the antibody is a monoclonal antibody.

7. The antibody of claim 1 wherein the antibody is a human antibody.

8. The antibody of claim 1 which comprises a heavy chain immunoglobulin constant domain selected from the group consisting of:

(a) a human IgM constant domain;

(b) a human IgG1 constant domain;

(c) a human IgG2 constant domain;

(d) a human IgG3 constant domain;

(e) a human IgG4 constant domain; and (f) a human IgA constant domain.

9. The antibody of claim 1 which comprises a light chain immunoglobulin constant domain selected from the group consisting of:

(a) a human kappa constant domain; and (b) a human lambda constant domain.

10. The antibody of claim 1 wherein the antibody has a dissociation constant ($K_D$) less than or equal to $10^{-9}$M.

11. The antibody of claim 1 wherein the antibody is coupled to a detectable label.

12. The antibody of claim 11 wherein the detectable label is a radioisotope, an enzyme, a fluorescent label, a luminescent label, bioluminescent label or biotin.

13. The antibody of claim 12 wherein the radioisotope is $^{125}I$, $^{131}I$, $^{111}In$, $^{90}Y$, $^{99m}Tc$, $^{177}Lu$, $^{166}Ho$, or $^{153}Sm$.

14. The antibody of claim 1 wherein the antibody neutralizes said protein.

15. The antibody of claim 14 wherein the antibody diminishes the ability of said protein to bind to a receptor of said protein.

16. The antibody of claim 15 wherein the receptor is TACI.

17. The antibody of claim 15 wherein the receptor is BCMA.

18. The antibody of claim 14 wherein the antibody diminishes the ability of said protein to stimulate B cell proliferation.

19. The antibody of claim 14 wherein the antibody diminishes the ability of said protein to stimulate immunoglobulin secretion by B cells.

20. The antibody of claim 4 wherein the antibody is selected from the group consisting of:

(a) a whole immunoglobulin molecule;

(b) an scFv;

(c) a chimeric antibody;

(d) a Fab fragment;

(e) an Fab' fragment; and (f) an F(ab')2.

21. The antibody of claim 4 wherein the antibody is a monoclonal antibody.

22. The antibody of claim 4 wherein the antibody is a human antibody.

23. The antibody of claim 4 which comprises a heavy chain immunoglobulin constant domain selected from the group consisting of:

(a) a human IgM constant domain;

(b) a human IgG1 constant domain;

(c) a human IgG2 constant domain;

(d) a human IgG3 constant domain;

(e) a human IgG4 constant domain; and (f) a human IgA constant domain.

24. The antibody of claim 4 which comprises a light chain immunoglobulin constant domain selected from the group consisting of:

(a) a human kappa constant domain; and (b) a human lambda constant domain.

25. The antibody of claim 4 wherein the antibody is coupled to a detectable label.

26. The antibody of claim 25 wherein the detectable label is a radioisotope, an enzyme, a fluorescent label, a luminescent label, bioluminescent label or biotin.

27. The antibody of claim 26 wherein the radioisotope is $^{125}I$, $^{131}I$, $^{111}In$, $^{90}Y$, $^{99m}Tc$, $^{177}Lu$, $^{166}Ho$, or $^{153}Sm$.

28. An antibody purified from the cell line contained in American Type Culture Collection Deposit Number PTA-3239.

29. An antibody purified from the cell line contained in American Type Culture Collection Deposit Number PTA-3240.

30. The antibody of claim 4 which comprises a human IgG1 heavy chain immunoglobulin constant domain and a human lambda light chain immunoglobulin constant domain.

31. The antibody of claim 4 wherein the antibody neutralizes said protein.

32. The antibody of claim 31 wherein the antibody diminishes the ability of said protein to bind to a receptor of said protein.

33. The antibody of claim 32 wherein the receptor is TACI.

34. The antibody of claim 32 wherein the receptor is BCMA.

35. The antibody of claim 31 wherein the antibody diminishes the ability of said protein to stimulate B cell proliferation.

36. The antibody of claim 31 wherein the antibody diminishes the ability of said protein to stimulate immunoglobulin secretion by B cells.

37. An isolated antibody that immunospecifically binds B Lymphocyte Stimulator protein wherein said antibody comprises amino acid residues 1–123 of SEQ ID NO:2 and amino acid residues 141–249 of SEQ ID NO:2 and wherein said B Lymphocyte Stimulator protein is selected from the group consisting of:

(a) a protein whose amino acid sequence consists of amino acid residues 1–285 of SEQ ID NO:3228;

(b) a protein whose amino acid sequence consists of amino acid residues 134–285 of SEQ ID NO:3228; and (c) a trimer of the protein of (b).

* * * * *

UNITED STATES PATENT AND TRADEMARK OFFICE

CERTIFICATE OF CORRECTION

PATENT NO. : 7,138,501 B2
APPLICATION NO. : 09/880748
DATED : November 21, 2006
INVENTOR(S) : Ruben et al.

It is certified that error appears in the above-identified patent and that said Letters Patent is hereby corrected as shown below:

In the Title:

Delete "ANTIBODIES THAT IMMUNOSPECIICALLY BIND TO BLYS" and replace with --ANTIBODIES THAT IMMUNOSPECIFICALLY BIND TO B LYMPHOCYTE STIMULATOR PROTEIN--.

Title Page:

At INID (56) – Other Publications, delete "Kennell, D.E., Prog. Nucl. Acid Res. Med. Biol, 11:259:301 1971."

In the Specification:

Replace Table 1, spanning pages 213-304 with the attached Table 1.

Signed and Sealed this

Sixth Day of March, 2007

JON W. DUDAS
*Director of the United States Patent and Trademark Office*

Table 1: scFvs that Immunospecifically Bind to B Lymphocyte Stimulator

| Clone ID | scFv SEQ ID NO | AAs of VL | AAs of VL CDR1 | AAs of VL CDR2 | AAs of VL CDR3 | AAs of VH | AAs of VH CDR1 | AAs of VH CDR2 | AAs of VH CDR3 | VH CDR3 Sequence (SEQ ID NO) |
|---|---|---|---|---|---|---|---|---|---|---|
| I003F12S | 1 | 138 - 248 | 160 - 173 | 189 - 195 | 228 - 237 | 1 - 122 | 26 - 35 | 50 - 66 | 99 - 111 | HDDDVLTGYYFES (SEQ ID NO: 2130) |
| I006D08 | 2 | 141 - 249 | 163 - 173 | 189 - 195 | 228 - 238 | 1 - 123 | 26 - 35 | 50 - 66 | 99 - 112 | SRDLLLFPHYGMDV (SEQ ID NO: 2133) |
| I008A11 | 3 | 144 - 254 | 166 - 179 | 195 - 201 | 234 - 243 | 1 - 128 | 26 - 37 | 52 - 69 | 102 - 117 | DRYDILTGYYYYGMDV (SEQ ID NO: 2129) |
| I017D10 | 4 | 148 - 255 | 169 - 179 | 195 - 201 | 234 - 244 | 1 - 132 | 26 - 35 | 50 - 66 | 99 - 121 | VQMDSEYYDLLTGINVGPYYFDY (SEQ ID NO: 2132) |
| I022D01 | 5 | 142 - 249 | 163 - 173 | 189 - 195 | 228 - 238 | 1 - 126 | 26 - 35 | 50 - 66 | 99 - 115 | DGYYDILTGYSYYGMDV (SEQ ID NO: 2135) |
| I031F02 | 6 | 138 - 251 | 160 - 173 | 189 - 195 | 228 - 240 | 1 - 121 | 26 - 35 | 50 - 66 | 99 - 110 | GYDSSAFRAFDI (SEQ ID NO: 2136) |
| I050A12 | 7 | 142 - 250 | 164 - 174 | 190 - 196 | 229 - 239 | 1 - 124 | 26 - 35 | 50 - 66 | 99 - 113 | APYDLLTHYFHYFDY (SEQ ID NO: 2134) |
| I051C04 | 8 | 146 - 256 | 168 - 181 | 197 - 203 | 236 - 245 | 1 - 129 | 26 - 35 | 50 - 66 | 99 - 118 | AATTSQKHNKYAYYFYGMDV (SEQ ID NO: 2131) |
| I050B11 | 9 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| I050B11-01 | 10 | 143 - 251 | 166 - 177 | 193 - 199 | 232 - 240 | 1 - 125 | 26 - 35 | 50 - 66 | 99 - 114 | PFYDILTSYVFQVWVA (SEQ ID NO: 2143) |
| I050B11-02 | 11 | 143 - 251 | 166 - 177 | 193 - 199 | 232 - 240 | 1 - 125 | 26 - 35 | 50 - 66 | 99 - 114 | PFYDILTSYVFQVWVA (SEQ ID NO: 2143) |
| I050B11-03 | 12 | 143 - 251 | 166 - 177 | 193 - 199 | 232 - 240 | 1 - 125 | 26 - 35 | 50 - 66 | 99 - 114 | PFYDTLTRYVFQYFDH (SEQ ID NO: 2144) |
| I050B11-04 | 13 | 143 - 251 | 166 - 177 | 193 - 199 | 232 - 240 | 1 - 125 | 26 - 35 | 50 - 66 | 99 - 114 | PFYDILTGYVFQYFDH (SEQ ID NO: 2141) |
| I050B11-05 | 14 | 143 - 251 | 166 - 177 | 193 - 199 | 232 - 240 | 1 - 125 | 26 - 35 | 50 - 66 | 99 - 114 | PFYDILTRYVFQVWVA (SEQ ID NO: 2142) |
| I050B11-06 | 15 | 143 - 251 | 166 - 177 | 193 - 199 | 232 - 240 | 1 - 125 | 26 - 35 | 50 - 66 | 99 - 114 | PFYDTLTGYVFQVWVA (SEQ ID NO: 2140) |
| I050B11-07 | 16 | 143 - 251 | 166 - 177 | 193 - 199 | 232 - 240 | 1 - 125 | 26 - 35 | 50 - 66 | 99 - 114 | PFYDTLTRYVFQYFDH (SEQ ID NO: 2144) |
| I050B11-08 | 17 | 143 - 251 | 166 - 177 | 193 - 199 | 232 - 240 | 1 - 125 | 26 - 35 | 50 - 66 | 99 - 114 | PFYDILTGYVFQYFDH (SEQ ID NO: 2141) |
| I050B11-09 | 18 | 143 - 251 | 166 - 177 | 193 - 199 | 232 - 240 | 1 - 125 | 26 - 35 | 50 - 66 | 99 - 114 | PFYDILTRYVFQVWVA (SEQ ID NO: 2142) |
| I050B11-10 | 19 | 143 - 251 | 166 - 177 | 193 - 199 | 232 - 240 | 1 - 125 | 26 - 35 | 50 - 66 | 99 - 114 | PFYDILTRYVFQVWVA (SEQ ID NO: 2142) |
| I050B11-11 | 20 | 143 - 251 | 166 - 177 | 193 - 199 | 232 - 240 | 1 - 125 | 26 - 35 | 50 - 66 | 99 - 114 | PFYDTLTGYVFQVWVA (SEQ ID NO: 2140) |
| I050B11-12 | 21 | 143 - 251 | 166 - 177 | 193 - 199 | 232 - 240 | 1 - 125 | 26 - 35 | 50 - 66 | 99 - 114 | PFYDTLTGYVFQVWVA (SEQ ID NO: 2140) |
| I050B11-13 | 22 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| I050B11-14 | 23 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| I050B11-15 | 24 | 143 - 251 | 166 - 177 | 193 - 199 | 232 - 240 | 1 - 125 | 26 - 35 | 50 - 66 | 99 - 114 | PFYDTLTSYVFQVWVA (SEQ ID NO: 2143) |
| I050B11-16 | 25 | 143 - 251 | 166 - 177 | 193 - 199 | 232 - 240 | 1 - 125 | 26 - 35 | 50 - 66 | 99 - 114 | PFYDTLTSYVFQVWVA (SEQ ID NO: 2143) |
| I050B11-17 | 26 | 143 - 251 | 166 - 177 | 193 - 199 | 232 - 240 | 1 - 125 | 26 - 35 | 50 - 66 | 99 - 114 | PFYDTLTRYVFQYFDH (SEQ ID NO: 2144) |
| I050B11-18 | 27 | 143 - 251 | 166 - 177 | 193 - 199 | 232 - 240 | 1 - 125 | 26 - 35 | 50 - 66 | 99 - 114 | PFYDTLTRYVFQYFDH (SEQ ID NO: 2144) |
| I050B11-19 | 28 | 143 - 251 | 166 - 177 | 193 - 199 | 232 - 240 | 1 - 125 | 26 - 35 | 50 - 66 | 99 - 114 | PFYDILTSYVFQYFDH (SEQ ID NO: 2139) |
| I050B11-20 | 29 | 143 - 251 | 166 - 177 | 193 - 199 | 232 - 240 | 1 - 125 | 26 - 35 | 50 - 66 | 99 - 114 | PFYDILTSYVFQYFDH (SEQ ID NO: 2139) |
| I050B11-21 | 30 | 143 - 251 | 166 - 177 | 193 - 199 | 232 - 240 | 1 - 125 | 26 - 35 | 50 - 66 | 99 - 114 | PFYDILTRYVFQYFDH (SEQ ID NO: 2138) |
| I050B11-22 | 31 | 143 - 251 | 166 - 177 | 193 - 199 | 232 - 240 | 1 - 125 | 26 - 35 | 50 - 66 | 99 - 114 | PFYDILTRYVFQYFDH (SEQ ID NO: 2138) |
| I050B11-23 | 32 | 143 - 251 | 166 - 177 | 193 - 199 | 232 - 240 | 1 - 125 | 26 - 35 | 50 - 66 | 99 - 114 | PFYDILTRYVFQYFDH (SEQ ID NO: 2138) |
| I050B11-24 | 33 | 143 - 251 | 166 - 177 | 193 - 199 | 232 - 240 | 1 - 125 | 26 - 35 | 50 - 66 | 99 - 114 | PFYDILTSYVFQYFDH (SEQ ID NO: 2139) |
| I050B11-25 | 34 | 143 - 251 | 166 - 177 | 193 - 199 | 232 - 240 | 1 - 125 | 26 - 35 | 50 - 66 | 99 - 114 | PFYDTLTRYVFQYFDH (SEQ ID NO: 2144) |
| I050B11-26 | 35 | 143 - 251 | 166 - 177 | 193 - 199 | 232 - 240 | 1 - 125 | 26 - 35 | 50 - 66 | 99 - 114 | PFYDILTSYVFQYFDH (SEQ ID NO: 2139) |

| | | | | | | | | | | |
|---|---|---|---|---|---|---|---|---|---|---|
| 1030B11-27 | 36 | 143 - 251 | 166 - 177 | 193 - 199 | 232 - 240 | 1 - 125 | 26 - 35 | 50 - 66 | 99 - 114 | PFYDILTRYVFQYFDH (SEQ ID NO: 2138) |
| 1030B11-28 | 37 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1093D03 | 38 | 143 - 251 | 166 - 177 | 193 - 199 | 232 - 240 | 1 - 125 | 26 - 35 | 50 - 66 | 99 - 114 | PFYDTLTSYVLGYYLS (SEQ ID NO: 2145) |
| 1093D09 | 39 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1093G08 | 40 | 143 - 251 | 166 - 177 | 193 - 199 | 232 - 240 | 1 - 125 | 26 - 35 | 50 - 66 | 99 - 114 | PFYDTLTSYVFQVWVA (SEQ ID NO: 2143) |
| 1097D11 | 41 | 143 - 251 | 166 - 177 | 193 - 199 | 232 - 240 | 1 - 125 | 26 - 35 | 50 - 66 | 99 - 114 | PFYDILTSYVFQYFDH (SEQ ID NO: 2139) |
| 1101A04 | 42 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1101B01 | 43 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1102A02 | 44 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1102E01 | 45 | 143 - 251 | 166 - 177 | 193 - 199 | 232 - 240 | 1 - 125 | 26 - 35 | 50 - 66 | 99 - 114 | PFYDTLTRYVFQYFDH (SEQ ID NO: 2144) |
| 1102G06 | 46 | 143 - 251 | 166 - 177 | 193 - 199 | 232 - 240 | 1 - 125 | 26 - 35 | 50 - 66 | 99 - 114 | PFYDTLTGYVFQYFDH (SEQ ID NO: 2141) |
| 1087A07 | 47 | 143 - 251 | 166 - 177 | 193 - 199 | 232 - 240 | 1 - 125 | 26 - 35 | 50 - 66 | 99 - 114 | PFYDTLTSYVLPRVIP (SEQ ID NO: 2227) |
| 1087A08 | 48 | 142 - 250 | 165 - 176 | 192 - 198 | 231 - 239 | 1 - 124 | 26 - 35 | 50 - 66 | 99 - 113 | PFYDTLTSYVCRPHF (SEQ ID NO: 2238) |
| 1087A09 | 49 | 142 - 250 | 165 - 176 | 192 - 198 | 231 - 239 | 1 - 124 | 26 - 35 | 50 - 66 | 99 - 113 | PFYDTLTSYVRCPYV (SEQ ID NO: 2272) |
| 1087B02 | 50 | 142 - 250 | 165 - 176 | 192 - 198 | 231 - 239 | 1 - 124 | 26 - 35 | 50 - 66 | 99 - 113 | PFYDTLTSYVFRPDL (SEQ ID NO: 2281) |
| 1087B03 | 51 | 142 - 250 | 165 - 176 | 192 - 198 | 231 - 239 | 1 - 124 | 26 - 35 | 50 - 66 | 99 - 113 | PFYDTLTSYVKSMPT (SEQ ID NO: 2305) |
| 1087B04 | 52 | 142 - 250 | 165 - 176 | 192 - 198 | 231 - 239 | 1 - 124 | 26 - 35 | 50 - 66 | 99 - 113 | PFYDTLTSYVPFLYC (SEQ ID NO: 2292) |
| 1087B05 | 53 | 142 - 250 | 165 - 176 | 192 - 198 | 231 - 239 | 1 - 124 | 26 - 35 | 50 - 66 | 99 - 113 | PFYDTLTSYVPVPST (SEQ ID NO: 2270) |
| 1087B06 | 54 | 142 - 250 | 165 - 176 | 192 - 198 | 231 - 239 | 1 - 124 | 26 - 35 | 50 - 66 | 99 - 113 | PFYDTLTSYVGIHGL (SEQ ID NO: 2282) |
| 1087B08 | 55 | 143 - 251 | 166 - 177 | 193 - 199 | 232 - 240 | 1 - 125 | 26 - 35 | 50 - 66 | 99 - 114 | PFYDTLTSYVPCSPPR (SEQ ID NO: 2261) |
| 1087B09 | 56 | 142 - 250 | 165 - 176 | 192 - 198 | 231 - 239 | 1 - 124 | 26 - 35 | 50 - 66 | 99 - 113 | PFYDTLTSYVCYPPA (SEQ ID NO: 2240) |
| 1087C02 | 57 | 142 - 250 | 165 - 176 | 192 - 198 | 231 - 239 | 1 - 124 | 26 - 35 | 50 - 66 | 99 - 113 | PFYDTLTSYVLPLLS (SEQ ID NO: 2224) |
| 1087C05 | 58 | 142 - 250 | 165 - 176 | 192 - 198 | 231 - 239 | 1 - 124 | 26 - 35 | 50 - 66 | 99 - 113 | PFYDILTSYVALYRL (SEQ ID NO: 2234) |
| 1087C06 | 59 | 142 - 250 | 165 - 176 | 192 - 198 | 231 - 239 | 1 - 124 | 26 - 35 | 50 - 66 | 99 - 113 | PFYDTLTSYVRASFS (SEQ ID NO: 2271) |
| 1087C07 | 60 | 142 - 250 | 165 - 176 | 192 - 198 | 231 - 239 | 1 - 124 | 26 - 35 | 50 - 66 | 99 - 113 | PFYDTLTSYVCTPVP (SEQ ID NO: 2319) |
| 1087C08 | 61 | 143 - 251 | 166 - 177 | 193 - 199 | 232 - 240 | 1 - 125 | 26 - 35 | 50 - 66 | 99 - 114 | PFYDTLTSYVWPSFFS (SEQ ID NO: 2277) |
| 1087D01 | 62 | 142 - 250 | 165 - 176 | 192 - 198 | 231 - 239 | 1 - 124 | 26 - 35 | 50 - 66 | 99 - 113 | PFYDTLTSYVTPRGY (SEQ ID NO: 2275) |
| 1087D02 | 63 | 142 - 250 | 165 - 176 | 192 - 198 | 231 - 239 | 1 - 124 | 26 - 35 | 50 - 66 | 99 - 113 | PFYDTLTSYVSSLLS (SEQ ID NO: 2213) |
| 1087D03 | 64 | 143 - 251 | 166 - 177 | 193 - 199 | 232 - 240 | 1 - 125 | 26 - 35 | 50 - 66 | 99 - 114 | PFYDTLTSYVPLLPLC (SEQ ID NO: 2263) |
| 1087D05 | 65 | 143 - 251 | 166 - 177 | 193 - 199 | 232 - 240 | 1 - 125 | 26 - 35 | 50 - 66 | 99 - 114 | PFYDTLTSYVPPPSFL (SEQ ID NO: 2256) |
| 1087D07 | 66 | 142 - 250 | 165 - 176 | 192 - 198 | 231 - 239 | 1 - 124 | 26 - 35 | 50 - 66 | 99 - 113 | PFYDTLTSYVPTSTT (SEQ ID NO: 2269) |
| 1087D09 | 67 | 143 - 251 | 166 - 177 | 193 - 199 | 232 - 240 | 1 - 125 | 26 - 35 | 50 - 66 | 99 - 114 | PFYDTLTSYVISCSWA (SEQ ID NO: 2299) |
| 1087E04 | 68 | 143 - 251 | 166 - 177 | 193 - 199 | 232 - 240 | 1 - 125 | 26 - 35 | 50 - 66 | 99 - 114 | PFYDTLTSYVSALPFP (SEQ ID NO: 2274) |
| 1087E05 | 69 | 142 - 250 | 165 - 176 | 192 - 198 | 231 - 239 | 1 - 124 | 26 - 35 | 50 - 66 | 99 - 113 | PFYDTLTSYVCRHLF (SEQ ID NO: 2236) |
| 1087E10 | 70 | 143 - 251 | 166 - 177 | 193 - 199 | 232 - 240 | 1 - 125 | 26 - 35 | 50 - 66 | 99 - 114 | PFYDTLTSYVVSFPSL (SEQ ID NO: 2307) |
| 1087F02 | 71 | 143 - 251 | 166 - 177 | 193 - 199 | 232 - 240 | 1 - 125 | 26 - 35 | 50 - 66 | 99 - 114 | PFYDTLTSYVMGVTPS (SEQ ID NO: 2322) |
| 1087F04 | 72 | 143 - 251 | 166 - 177 | 193 - 199 | 232 - 240 | 1 - 125 | 26 - 35 | 50 - 66 | 99 - 114 | PFYDTLTSYVLFRPVL (SEQ ID NO: 2326) |
| 1087F05 | 73 | 142 - 250 | 165 - 176 | 192 - 198 | 231 - 239 | 1 - 124 | 26 - 35 | 50 - 66 | 99 - 113 | PFYDTLTSYVFSVGG (SEQ ID NO: 2267) |
| 1087F07 | 74 | 142 - 250 | 165 - 176 | 192 - 198 | 231 - 239 | 1 - 124 | 26 - 35 | 50 - 66 | 99 - 113 | PFYDTLTSYVFPTRH (SEQ ID NO: 2286) |
| 1087F08 | 75 | 142 - 250 | 165 - 176 | 192 - 198 | 231 - 239 | 1 - 124 | 26 - 35 | 50 - 66 | 99 - 113 | PFYDTLTSYVLKSRD (SEQ ID NO: 2243) |
| 1087F09 | 76 | 142 - 250 | 165 - 176 | 192 - 198 | 231 - 239 | 1 - 124 | 26 - 35 | 50 - 66 | 99 - 113 | PFYDTLTSYVPLLPP (SEQ ID NO: 2310) |
| 1087G05 | 77 | 142 - 250 | 165 - 176 | 192 - 198 | 231 - 239 | 1 - 124 | 26 - 35 | 50 - 66 | 99 - 113 | PFYDTLTSYVLRCVL (SEQ ID NO: 2239) |

| | | | | | | | | | | |
|---|---|---|---|---|---|---|---|---|---|---|
| 1087G06 | 78 | 142 - 250 | 165 - 176 | 192 - 198 | 231 - 239 | 1 - 124 | 26 - 35 | 50 - 65 | 99 - 113 | PFYDTLTSYVHPSRS (SEQ ID NO: 2285) |
| 1087G07 | 79 | 143 - 251 | 166 - 177 | 193 - 199 | 232 - 240 | 1 - 125 | 26 - 35 | 50 - 66 | 99 - 114 | PFYDTLTSYVLRLPFQ (SEQ ID NO: 2241) |
| 1087G09 | 80 | 142 - 250 | 165 - 176 | 192 - 198 | 231 - 239 | 1 - 124 | 26 - 35 | 50 - 65 | 99 - 113 | PFYDTLTSYVGPYGT (SEQ ID NO: 2284) |
| 1087G10 | 81 | 142 - 250 | 165 - 176 | 192 - 198 | 231 - 239 | 1 - 124 | 26 - 35 | 50 - 66 | 99 - 113 | PFYDTLTSYVTTPCT (SEQ ID NO: 2276) |
| 1087H02 | 82 | 137 - 244 | 160 - 170 | 186 - 192 | 225 - 233 | 1 - 121 | 26 - 35 | 50 - 66 | 99 - 110 | ASYLSTSSSLDN (SEQ ID NO: 2265) |
| 1088A01 | 83 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1088A03 | 84 | 143 - 251 | 166 - 177 | 193 - 199 | 232 - 240 | 1 - 125 | 26 - 35 | 50 - 66 | 99 - 114 | PFYDTLTSYVIPFLPL (SEQ ID NO: 2290) |
| 1088A04 | 85 | 143 - 251 | 166 - 177 | 193 - 199 | 232 - 240 | 1 - 125 | 26 - 35 | 50 - 66 | 99 - 114 | PFYDTLTSYVLHIYPH (SEQ ID NO: 2335) |
| 1088A08 | 86 | 143 - 251 | 166 - 177 | 193 - 199 | 232 - 240 | 1 - 125 | 26 - 35 | 50 - 66 | 99 - 114 | PFYDTLTNYVFEYYAS (SEQ ID NO: 2323) |
| 1088A09 | 87 | 143 - 251 | 166 - 177 | 193 - 199 | 232 - 240 | 1 - 125 | 26 - 35 | 50 - 66 | 99 - 114 | PFYDTLTSYVILYYLH (SEQ ID NO: 2295) |
| 1088A10 | 88 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1088A11 | 89 | 143 - 251 | 166 - 177 | 193 - 199 | 232 - 240 | 1 - 125 | 26 - 35 | 50 - 65 | 99 - 114 | PFYDTLTSYVLMYFPH (SEQ ID NO: 2220) |
| 1088A12 | 90 | 143 - 251 | 166 - 177 | 193 - 199 | 232 - 240 | 1 - 125 | 26 - 35 | 50 - 65 | 99 - 114 | PFYDTLTSYVLFFYPL (SEQ ID NO: 2325) |
| 1088B01 | 91 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1088B02 | 92 | 143 - 251 | 166 - 177 | 193 - 199 | 232 - 240 | 1 - 125 | 26 - 35 | 50 - 66 | 99 - 114 | PFYDTLTSYVFDYYAS (SEQ ID NO: 2244) |
| 1088B03 | 93 | 143 - 251 | 166 - 177 | 193 - 199 | 232 - 240 | 1 - 125 | 26 - 35 | 50 - 66 | 99 - 114 | PFYDTLTSYVIPFLPL (SEQ ID NO: 2290) |
| 1088B05 | 94 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1088B06 | 95 | 143 - 251 | 166 - 177 | 193 - 199 | 232 - 240 | 1 - 125 | 26 - 35 | 50 - 66 | 99 - 114 | PFYDTLTSYVFEYYSL (SEQ ID NO: 2324) |
| 1088B07 | 96 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1088B08 | 97 | 143 - 251 | 166 - 177 | 193 - 199 | 232 - 240 | 1 - 125 | 26 - 35 | 50 - 65 | 99 - 114 | PFYDTLTSYVFQYFDH (SEQ ID NO: 2137) |
| 1088B09 | 98 | 143 - 251 | 166 - 177 | 193 - 199 | 232 - 240 | 1 - 125 | 26 - 35 | 50 - 65 | 99 - 114 | PFYDTLTSYVLEFYLL (SEQ ID NO: 2303) |
| 1088B10 | 99 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1088B12 | 100 | 142 - 250 | 165 - 176 | 192 - 198 | 231 - 239 | 1 - 124 | 26 - 35 | 50 - 66 | 99 - 113 | PFYDTLTSYVLPLDS (SEQ ID NO: 2223) |
| 1088C01 | 101 | 143 - 251 | 166 - 177 | 193 - 199 | 232 - 240 | 1 - 125 | 26 - 35 | 50 - 66 | 99 - 114 | PFYDTLTSYVLYFYPS (SEQ ID NO: 2317) |
| 1088C03 | 102 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1088C09 | 103 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1088C12 | 104 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1088D01 | 105 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1088D03 | 106 | 143 - 251 | 166 - 177 | 193 - 199 | 232 - 240 | 1 - 125 | 26 - 35 | 50 - 66 | 99 - 114 | PFYDTLTSYVLHYYAL (SEQ ID NO: 2215) |
| 1088D04 | 107 | 142 - 250 | 165 - 176 | 192 - 198 | 231 - 239 | 1 - 124 | 26 - 35 | 50 - 65 | 99 - 113 | PFYDTLTSYVLPPSV (SEQ ID NO: 2225) |
| 1088D07 | 108 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1088D08 | 109 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1088D11 | 110 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1088E01 | 111 | 140 - 248 | 163 - 174 | 190 - 196 | 229 - 237 | 1 - 122 | 23 - 32 | 47 - 63 | 96 - 111 | PFYDTLTSYVFQYFDH (SEQ ID NO: 2137) |
| 1088E02 | 112 | 143 - 251 | 166 - 177 | 193 - 199 | 232 - 240 | 1 - 125 | 26 - 35 | 50 - 66 | 99 - 114 | PFYDTLTSYVLHYYLY (SEQ ID NO: 2216) |
| 1088E03 | 113 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1088E04 | 114 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1088E08 | 115 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1088E10 | 116 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1088E11 | 117 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1088F07 | 118 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1088G02 | 119 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |

| | | | | | | | | | | |
|---|---|---|---|---|---|---|---|---|---|---|
| 1088G03 | 120 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1088G07 | 121 | 143 - 251 | 166 - 177 | 193 - 199 | 232 - 240 | 1 - 125 | 26 - 35 | 50 - 66 | 99 - 114 | PFYDTLTSYVFHYYPL (SEQ ID NO: 2260) |
| 1088G09 | 122 | 143 - 251 | 166 - 177 | 193 - 199 | 232 - 240 | 1 - 125 | 26 - 35 | 50 - 66 | 99 - 114 | PFYDTLTSYVFPVYYL (SEQ ID NO: 2264) |
| 1088G10 | 123 | 143 - 251 | 166 - 177 | 193 - 199 | 232 - 240 | 1 - 125 | 26 - 35 | 50 - 66 | 99 - 114 | PFYDTLTSYVLHFIDH (SEQ ID NO: 2301) |
| 1088H05 | 124 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1088H07 | 125 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1092A03 | 126 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1092A05 | 127 | 143 - 251 | 166 - 177 | 193 - 199 | 232 - 240 | 1 - 125 | 26 - 35 | 50 - 66 | 99 - 114 | PFYDTLTSYVFHYYDV (SEQ ID NO: 2258) |
| 1092A06 | 128 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1092A08 | 129 | 143 - 251 | 166 - 177 | 193 - 199 | 232 - 240 | 1 - 125 | 26 - 35 | 50 - 66 | 99 - 114 | PFYDTLTSYVHEFFSL (SEQ ID NO: 2283) |
| 1092A10 | 130 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1092A11 | 131 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1092B01 | 132 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1092B02 | 133 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1092B04 | 134 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1092B05 | 135 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1092B10 | 136 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1092B12 | 137 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1092C01 | 138 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1092C02 | 139 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1092C07 | 140 | 142 - 250 | 165 - 176 | 192 - 198 | 231 - 239 | 1 - 124 | 26 - 35 | 50 - 66 | 99 - 113 | PFYDTLTSYVLALDL (SEQ ID NO: 2328) |
| 1092C08 | 141 | 143 - 251 | 166 - 177 | 193 - 199 | 232 - 240 | 1 - 125 | 26 - 35 | 50 - 66 | 99 - 114 | PFYDTLTSYVFGYYSL (SEQ ID NO: 2254) |
| 1092C12 | 142 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1092D01 | 143 | 143 - 251 | 166 - 177 | 193 - 199 | 232 - 240 | 1 - 125 | 26 - 35 | 50 - 66 | 99 - 114 | PFYDTLTSYVLKYYTD (SEQ ID NO: 2226) |
| 1092D07 | 144 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1092D09 | 145 | 143 - 251 | 166 - 177 | 193 - 199 | 232 - 240 | 1 - 125 | 26 - 35 | 50 - 66 | 99 - 114 | PFYDTLTSYVMHAYPL (SEQ ID NO: 2255) |
| 1092D10 | 146 | 143 - 251 | 166 - 177 | 193 - 199 | 232 - 240 | 1 - 125 | 26 - 35 | 50 - 66 | 99 - 114 | PFYDTLTSYVFHYLPV (SEQ ID NO: 2256) |
| 1092D11 | 147 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1092E01 | 148 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1092E03 | 149 | 143 - 251 | 166 - 177 | 193 - 199 | 232 - 240 | 1 - 125 | 26 - 35 | 50 - 66 | 99 - 114 | PFYDTLTSYAFQYFDH (SEQ ID NO: 2230) |
| 1092E04 | 150 | 143 - 251 | 166 - 177 | 193 - 199 | 232 - 240 | 1 - 125 | 26 - 35 | 50 - 66 | 99 - 114 | PFYDTLTSYVFEYFSV (SEQ ID NO: 2248) |
| 1092E07 | 151 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1092E10 | 152 | 143 - 251 | 166 - 177 | 193 - 199 | 232 - 240 | 1 - 125 | 26 - 35 | 50 - 66 | 99 - 114 | PFYDTLTSYVLFYYPL (SEQ ID NO: 2327) |
| 1092E11 | 153 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1092F01 | 154 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1092F02 | 155 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1092F05 | 156 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1092F07 | 157 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1092F08 | 158 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1092F11 | 159 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1092F12 | 160 | 143 - 251 | 166 - 177 | 193 - 199 | 232 - 240 | 1 - 125 | 26 - 35 | 50 - 66 | 99 - 114 | PFYDTLTSYVLAYYPD (SEQ ID NO: 2306) |
| 1092G01 | 161 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |

| | | | | | | | | | | |
|---|---|---|---|---|---|---|---|---|---|---|
| I092G05 | 162 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| I092G10 | 163 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| I092H01 | 164 | 137 - 244 | 160 - 170 | 186 - 192 | 225 - 233 | 1 - 121 | 26 - 35 | 50 - 66 | 99 - 110 | ASYLSTSSSLDN (SEQ ID NO: 2265) |
| I093A06 | 165 | 143 - 251 | 166 - 177 | 193 - 199 | 232 - 240 | 1 - 125 | 26 - 35 | 50 - 66 | 99 - 114 | PFYDTLTSYVLPVYDH (SEQ ID NO: 2334) |
| I093A09 | 166 | 143 - 251 | 166 - 177 | 193 - 199 | 232 - 240 | 1 - 125 | 26 - 35 | 50 - 66 | 99 - 114 | PFYDTLTSYVFQYFAH (SEQ ID NO: 2268) |
| I093A11 | 167 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| I093A12 | 168 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| I093B02 | 169 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| I093B05 | 170 | 143 - 251 | 166 - 177 | 193 - 199 | 232 - 240 | 1 - 125 | 26 - 35 | 50 - 66 | 99 - 114 | PFYDTLTSYVIFYYFT (SEQ ID NO: 2289) |
| I093B06 | 171 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| I093B09 | 172 | 143 - 251 | 166 - 177 | 193 - 199 | 232 - 240 | 1 - 125 | 26 - 35 | 50 - 66 | 99 - 114 | PFYDTLTSYVLEVYHP (SEQ ID NO: 2318) |
| I093B12 | 173 | 143 - 251 | 166 - 177 | 193 - 199 | 232 - 240 | 1 - 125 | 26 - 35 | 50 - 66 | 99 - 114 | PFYDTLTSYVFAPLYT (SEQ ID NO: 2242) |
| I093C02 | 174 | 143 - 251 | 166 - 177 | 193 - 199 | 232 - 240 | 1 - 125 | 26 - 35 | 50 - 66 | 99 - 114 | PFYDTLTSYVLHAYAF (SEQ ID NO: 2332) |
| I093C03 | 175 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| I093C05 | 176 | 143 - 251 | 166 - 177 | 193 - 199 | 232 - 240 | 1 - 125 | 26 - 35 | 50 - 66 | 99 - 114 | PFYDTLTSYVILYYLH (SEQ ID NO: 2295) |
| I093D05 | 177 | 143 - 251 | 166 - 177 | 193 - 199 | 232 - 240 | 1 - 125 | 26 - 35 | 50 - 66 | 99 - 114 | PFYDTLTSYVFEFLFL (SEQ ID NO: 2245) |
| I093D08 | 178 | 143 - 251 | 166 - 177 | 193 - 199 | 232 - 240 | 1 - 125 | 26 - 35 | 50 - 66 | 99 - 114 | PFYDTLTSYVRPFYAH (SEQ ID NO: 2273) |
| I093D10 | 179 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| I093D12 | 180 | 143 - 251 | 166 - 177 | 193 - 199 | 232 - 240 | 1 - 125 | 26 - 35 | 50 - 66 | 99 - 114 | PFYDTLTSYVLHFYRV (SEQ ID NO: 2302) |
| I093E01 | 181 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| I093E02 | 182 | 143 - 251 | 166 - 177 | 193 - 199 | 232 - 240 | 1 - 125 | 26 - 35 | 50 - 66 | 99 - 114 | PFYDTLTSYVIQYFDH (SEQ ID NO: 2297) |
| I093E05 | 183 | 143 - 251 | 166 - 177 | 193 - 199 | 232 - 240 | 1 - 125 | 26 - 35 | 50 - 66 | 99 - 114 | PFYDTLTSYVHEFFSL (SEQ ID NO: 2283) |
| I093E08 | 184 | 143 - 251 | 166 - 177 | 193 - 199 | 232 - 240 | 1 - 125 | 26 - 35 | 50 - 66 | 99 - 114 | PFYDTLTSYVMQFFFT (SEQ ID NO: 2321) |
| I093E10 | 185 | 143 - 251 | 166 - 177 | 193 - 199 | 232 - 240 | 1 - 125 | 26 - 35 | 50 - 66 | 99 - 114 | PFYDTLTSYVLSFYPV (SEQ ID NO: 2246) |
| I093F01 | 186 | 143 - 251 | 166 - 177 | 193 - 199 | 232 - 240 | 1 - 125 | 26 - 35 | 50 - 66 | 99 - 114 | PFYDTLTSYVLYYYAF (SEQ ID NO: 2251) |
| I093F03 | 187 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| I093F05 | 188 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| I093F08 | 189 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| I093F11 | 190 | 143 - 251 | 166 - 177 | 193 - 199 | 232 - 240 | 1 - 125 | 26 - 35 | 50 - 66 | 99 - 114 | PFYDTLTSYVLHFYPL (SEQ ID NO: 2333) |
| I093G07 | 191 | 143 - 251 | 166 - 177 | 193 - 199 | 232 - 240 | 1 - 125 | 26 - 35 | 50 - 66 | 99 - 114 | PFYDTLTSYVLQYYVL (SEQ ID NO: 2237) |
| I093G11 | 192 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| I093G12 | 193 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| I093H06 | 194 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| I094A08 | 195 | 143 - 251 | 166 - 177 | 193 - 199 | 232 - 240 | 1 - 125 | 26 - 35 | 50 - 66 | 99 - 114 | PFYDTLTSYVFQYFDY (SEQ ID NO: 2280) |
| I094B07 | 196 | 143 - 251 | 166 - 177 | 193 - 199 | 232 - 240 | 1 - 125 | 26 - 35 | 50 - 66 | 99 - 114 | PFYDTLTSYVLPVWVS (SEQ ID NO: 2228) |
| I094B08 | 197 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| I094B12 | 198 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| I094C11 | 199 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| I094C12 | 200 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| I094D06 | 201 | 143 - 251 | 166 - 177 | 193 - 199 | 232 - 240 | 1 - 125 | 26 - 35 | 50 - 66 | 99 - 114 | PFYDTLTSYVIEYYPV (SEQ ID NO: 2288) |
| I094D07 | 202 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| I094D08 | 203 | 143 - 251 | 166 - 177 | 193 - 199 | 232 - 240 | 1 - 125 | 26 - 35 | 50 - 66 | 99 - 114 | PFYDTLTSYVLHYLPL (SEQ ID NO: 2314) |

| | | | | | | | | | | |
|---|---|---|---|---|---|---|---|---|---|---|
| 1094D09 | 204 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1094D10 | 205 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1094D11 | 206 | 143 - 251 | 166 - 177 | 193 - 199 | 232 - 240 | 1 - 125 | 26 - 35 | 50 - 66 | 99 - 114 | PFYDTLTSYVFHFYPV (SEQ ID NO: 2218) |
| 1094E04 | 207 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1094E08 | 208 | 143 - 251 | 166 - 177 | 193 - 199 | 232 - 240 | 1 - 125 | 26 - 35 | 50 - 66 | 99 - 114 | PFYDTLTSYVLEAPSL (SEQ ID NO: 2311) |
| 1094F04 | 209 | 143 - 251 | 166 - 177 | 193 - 199 | 232 - 240 | 1 - 125 | 26 - 35 | 50 - 66 | 99 - 114 | PFYDTLTSYVFGFYPF (SEQ ID NO: 2252) |
| 1094F05 | 210 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1094F10 | 211 | 143 - 251 | 166 - 177 | 193 - 199 | 232 - 240 | 1 - 125 | 26 - 35 | 50 - 66 | 99 - 114 | FIYDTLTSYVFQYFDH (SEQ ID NO: 2278) |
| 1094F11 | 212 | 143 - 251 | 166 - 177 | 193 - 199 | 232 - 240 | 1 - 125 | 26 - 35 | 50 - 66 | 99 - 114 | PFYDTLTSYVLWYYQD (SEQ ID NO: 2249) |
| 1094F12 | 213 | 143 - 251 | 166 - 177 | 193 - 199 | 232 - 240 | 1 - 125 | 26 - 35 | 50 - 66 | 99 - 114 | PFYDTLTSYVIPFYPL (SEQ ID NO: 2296) |
| 1094G06 | 214 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1094G10 | 215 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1095A04 | 216 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1095A12 | 217 | 143 - 251 | 166 - 177 | 193 - 199 | 232 - 240 | 1 - 125 | 26 - 35 | 50 - 66 | 99 - 114 | PFYDTLTSYVLEYFPL (SEQ ID NO: 2320) |
| 1095B04 | 218 | 143 - 251 | 166 - 177 | 193 - 199 | 232 - 240 | 1 - 125 | 26 - 35 | 50 - 66 | 99 - 114 | PFYDTLTSYVLEFFPA (SEQ ID NO: 2312) |
| 1095B09 | 219 | 143 - 251 | 166 - 177 | 193 - 199 | 232 - 240 | 1 - 125 | 26 - 35 | 50 - 66 | 99 - 114 | PFYDTLTSYVIEYLPL (SEQ ID NO: 2287) |
| 1095B10 | 220 | 143 - 251 | 166 - 177 | 193 - 199 | 232 - 240 | 1 - 125 | 26 - 35 | 50 - 66 | 99 - 114 | PFYDTLTSYVLHYYSA (SEQ ID NO: 2217) |
| 1095C02 | 221 | 143 - 251 | 166 - 177 | 193 - 199 | 232 - 240 | 1 - 125 | 26 - 35 | 50 - 66 | 99 - 114 | PFYDTLTSYVLFYYTA (SEQ ID NO: 2331) |
| 1095C05 | 222 | 143 - 251 | 166 - 177 | 193 - 199 | 232 - 240 | 1 - 125 | 26 - 35 | 50 - 66 | 99 - 114 | PFYDTLTSYVLHYLPV (SEQ ID NO: 2337) |
| 1095C07 | 223 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1095C08 | 224 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1095C09 | 225 | 143 - 251 | 166 - 177 | 193 - 199 | 232 - 240 | 1 - 125 | 26 - 35 | 50 - 66 | 99 - 114 | PFYDTLTSYVMHYYPT (SEQ ID NO: 2259) |
| 1095D01 | 226 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1095D02 | 227 | 143 - 251 | 166 - 177 | 193 - 199 | 232 - 240 | 1 - 125 | 26 - 35 | 50 - 66 | 99 - 114 | PFYDTLTSYVLQYFRY (SEQ ID NO: 2235) |
| 1095D03 | 228 | 143 - 251 | 166 - 177 | 193 - 199 | 232 - 240 | 1 - 125 | 26 - 35 | 50 - 66 | 99 - 114 | PFYDTLTSYVLQVFDT (SEQ ID NO: 2233) |
| 1095D05 | 229 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1095D09 | 230 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1095E01 | 231 | 143 - 251 | 166 - 177 | 193 - 199 | 232 - 240 | 1 - 125 | 26 - 35 | 50 - 66 | 99 - 114 | PFYDTLTSYVLDYYSS (SEQ ID NO: 2309) |
| 1095E05 | 232 | 143 - 251 | 166 - 177 | 193 - 199 | 232 - 240 | 1 - 125 | 26 - 35 | 50 - 66 | 99 - 114 | PFYDALTSYVFQYFDH (SEQ ID NO: 2221) |
| 1095E12 | 233 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1095F06 | 234 | 143 - 251 | 166 - 177 | 193 - 199 | 232 - 240 | 1 - 125 | 26 - 35 | 50 - 66 | 99 - 114 | PFYDTLTSYVFPFYPH (SEQ ID NO: 2262) |
| 1095F09 | 235 | 143 - 251 | 166 - 177 | 193 - 199 | 232 - 240 | 1 - 125 | 26 - 35 | 50 - 66 | 99 - 114 | PFYDTLTSYVIGFYPV (SEQ ID NO: 2291) |
| 1095G06 | 236 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1095G09 | 237 | 143 - 251 | 166 - 177 | 193 - 199 | 232 - 240 | 1 - 125 | 26 - 35 | 50 - 66 | 99 - 114 | PFYDTLTSYVMDFYSV (SEQ ID NO: 2253) |
| 1095G11 | 238 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1096A01 | 239 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1096A10 | 240 | 143 - 251 | 166 - 177 | 193 - 199 | 232 - 240 | 1 - 125 | 26 - 35 | 50 - 66 | 99 - 114 | PFYDTLTSYVLPFYAL (SEQ ID NO: 2222) |
| 1096B01 | 241 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1096B03 | 242 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1096C01 | 243 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1096C06 | 244 | 143 - 251 | 166 - 177 | 193 - 199 | 232 - 240 | 1 - 125 | 26 - 35 | 50 - 66 | 99 - 114 | PFYDTLTSYVLPYLTH (SEQ ID NO: 2229) |
| 1096C09 | 245 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |

| | | | | | | | | | | |
|---|---|---|---|---|---|---|---|---|---|---|
| 1096D01 | 246 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1096D02 | 247 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1096D05 | 248 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1096D06 | 249 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1096D09 | 250 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1096E02 | 251 | 143 - 251 | 166 - 177 | 193 - 199 | 232 - 240 | 1 - 125 | 26 - 35 | 50 - 66 | 99 - 114 | PFYDTLTSYVLGFYPV (SEQ ID NO: 2329) |
| 1096E06 | 252 | 143 - 251 | 166 - 177 | 193 - 199 | 232 - 240 | 1 - 125 | 26 - 35 | 50 - 66 | 99 - 114 | PFYDTLTSYVLHYHTH (SEQ ID NO: 2336) |
| 1096E11 | 253 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1096F02 | 254 | 143 - 251 | 166 - 177 | 193 - 199 | 232 - 240 | 1 - 125 | 26 - 35 | 50 - 66 | 99 - 114 | PFYDTLTSYVIHFLPL (SEQ ID NO: 2330) |
| 1096G01 | 255 | 143 - 251 | 166 - 177 | 193 - 199 | 232 - 240 | 1 - 125 | 26 - 35 | 50 - 66 | 99 - 114 | PFYDTLTSYVIPFLPL (SEQ ID NO: 2290) |
| 1096G02 | 256 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1096G05 | 257 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1096G07 | 258 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1096G09 | 259 | 143 - 251 | 166 - 177 | 193 - 199 | 232 - 240 | 1 - 125 | 26 - 35 | 50 - 66 | 99 - 114 | PFYDTLTSYVMHYLPV (SEQ ID NO: 2257) |
| 1096G12 | 260 | 143 - 251 | 166 - 177 | 193 - 199 | 232 - 240 | 1 - 125 | 26 - 35 | 50 - 66 | 99 - 114 | PFYDTLTSYVLEFFSH (SEQ ID NO: 2315) |
| 1096H01 | 261 | 137 - 244 | 160 - 170 | 186 - 192 | 225 - 233 | 1 - 121 | 26 - 35 | 50 - 66 | 99 - 110 | ASYLSTSSSLDN (SEQ ID NO: 2265) |
| 1097A04 | 262 | 143 - 251 | 166 - 177 | 193 - 199 | 232 - 240 | 1 - 125 | 26 - 35 | 50 - 66 | 99 - 114 | PFYDTLTSYVIHYLVT (SEQ ID NO: 2234) |
| 1097A06 | 263 | 143 - 251 | 166 - 177 | 193 - 199 | 232 - 240 | 1 - 125 | 26 - 35 | 50 - 66 | 99 - 114 | PFYDTLTSYVLPYYTL (SEQ ID NO: 2231) |
| 1097A09 | 264 | 143 - 251 | 166 - 177 | 193 - 199 | 232 - 240 | 1 - 125 | 26 - 35 | 50 - 66 | 99 - 114 | PFYDTLTSYVLHYYPI (SEQ ID NO: 2298) |
| 1097B02 | 265 | 143 - 251 | 166 - 177 | 193 - 199 | 232 - 240 | 1 - 125 | 26 - 35 | 50 - 66 | 99 - 114 | PFYDTLTSYVLWFYPL (SEQ ID NO: 2247) |
| 1097B09 | 266 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1097B10 | 267 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1097B11 | 268 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1097C05 | 269 | 143 - 251 | 166 - 177 | 193 - 199 | 232 - 240 | 1 - 125 | 26 - 35 | 50 - 66 | 99 - 114 | PFYDTLTSYVLHYYTH (SEQ ID NO: 2219) |
| 1097C09 | 270 | 143 - 251 | 166 - 177 | 193 - 199 | 232 - 240 | 1 - 125 | 26 - 35 | 50 - 66 | 99 - 114 | PFYDTLTSYVLHYYAY (SEQ ID NO: 2316) |
| 1097C11 | 271 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1097D05 | 272 | 143 - 251 | 166 - 177 | 193 - 199 | 232 - 240 | 1 - 125 | 26 - 35 | 50 - 66 | 99 - 114 | PFYDTLTSYVIHFYSL (SEQ ID NO: 2293) |
| 1097D06 | 273 | 143 - 251 | 166 - 177 | 193 - 199 | 232 - 240 | 1 - 125 | 26 - 35 | 50 - 66 | 99 - 114 | PFYDTLTSYVFGFFPH (SEQ ID NO: 2300) |
| 1097E01 | 274 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1097E04 | 275 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1097E08 | 276 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1097E09 | 277 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1097F09 | 278 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1097G10 | 279 | 143 - 251 | 166 - 177 | 193 - 199 | 232 - 240 | 1 - 125 | 26 - 35 | 50 - 66 | 99 - 114 | PFYDTLTSYVFQYFAH (SEQ ID NO: 2268) |
| 1097H02 | 280 | 137 - 244 | 160 - 170 | 186 - 192 | 225 - 233 | 1 - 121 | 26 - 35 | 50 - 66 | 99 - 110 | ASYLSTSSSLDN (SEQ ID NO: 2265) |
| 1098A04 | 281 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1098A05 | 282 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1098B08 | 283 | 143 - 251 | 166 - 177 | 193 - 199 | 232 - 240 | 1 - 125 | 26 - 35 | 50 - 66 | 99 - 114 | PFYDTLTSYVLDFYSV (SEQ ID NO: 2308) |
| 1098C01 | 284 | 143 - 251 | 166 - 177 | 193 - 199 | 232 - 240 | 1 - 125 | 26 - 35 | 50 - 66 | 99 - 114 | PIYDTLTSYVFQYFDH (SEQ ID NO: 2278) |
| 1098C04 | 285 | 143 - 251 | 166 - 177 | 193 - 199 | 232 - 240 | 1 - 125 | 26 - 35 | 50 - 66 | 99 - 114 | PFYDTLTSYVLYYYAP (SEQ ID NO: 2251) |
| 1098F11 | 286 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1098F12 | 287 | 143 - 251 | 166 - 177 | 193 - 199 | 232 - 240 | 1 - 125 | 26 - 35 | 50 - 66 | 99 - 114 | PFYDTLTSYVFFFYPF (SEQ ID NO: 2250) |

| | | | | | | | | | | |
|---|---|---|---|---|---|---|---|---|---|---|
| 1098G02 | 288 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1098G12 | 289 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1098H03 | 290 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1101A01 | 291 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1101B04 | 292 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1101B06 | 293 | 143 - 251 | 166 - 177 | 193 - 199 | 232 - 240 | 1 - 125 | 26 - 35 | 50 - 66 | 99 - 114 | PFYDTLTSYVIPFLTH (SEQ ID NO: 2304) |
| 1101D04 | 294 | 143 - 251 | 166 - 177 | 193 - 199 | 232 - 240 | 1 - 125 | 26 - 35 | 50 - 66 | 99 - 114 | PFYDTLTSYVLEFFPD (SEQ ID NO: 2313) |
| 1101D07 | 295 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1101E09 | 296 | 143 - 251 | 166 - 177 | 193 - 199 | 232 - 240 | 1 - 125 | 26 - 35 | 50 - 66 | 99 - 114 | PFYDTLTSYVFQYFDR (SEQ ID NO: 2279) |
| 1101E12 | 297 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1101G02 | 298 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1101G11 | 299 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1102C03 | 300 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1102E09 | 301 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1102F02 | 302 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1102G08 | 303 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1102G09 | 304 | 143 - 251 | 166 - 177 | 193 - 199 | 232 - 240 | 1 - 125 | 26 - 35 | 50 - 66 | 99 - 114 | PFYDTLTSYVLHYYAH (SEQ ID NO: 2214) |
| 1106A09 | 305 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1106B02 | 306 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1106B06 | 307 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1106C07 | 308 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1106E05 | 309 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1106E12 | 310 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1106G01 | 311 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1106G03 | 312 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1109B05 | 313 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1109D12 | 314 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1109E12 | 315 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1109G06 | 316 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1109H04 | 317 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1110B03 | 318 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1112D09 | 319 | 143 - 251 | 166 - 177 | 193 - 199 | 232 - 240 | 1 - 125 | 26 - 35 | 50 - 66 | 99 - 114 | PFYDTLTSYGFQYFDH (SEQ ID NO: 2232) |
| 1112F10 | 320 | 143 - 251 | 166 - 177 | 193 - 199 | 232 - 240 | 1 - 125 | 26 - 35 | 50 - 66 | 99 - 114 | PFYDTLTSYVFQYFDH (SEQ ID NO: 2137) |
| 1089F12 | 321 | 141 - 249 | 163 - 173 | 189 - 195 | 228 - 238 | 1 - 123 | 26 - 35 | 50 - 66 | 99 - 112 | SRDLLLFPHHGLDS (SEQ ID NO: 2146) |
| 1105E12 | 322 | 141 - 249 | 163 - 173 | 189 - 195 | 228 - 238 | 1 - 123 | 26 - 35 | 50 - 66 | 99 - 112 | SRDLLLFPHHSFDL (SEQ ID NO: 2147) |
| 1108D08 | 323 | 141 - 249 | 163 - 173 | 189 - 195 | 228 - 238 | 1 - 123 | 26 - 35 | 50 - 66 | 99 - 112 | SRDLLLFPLAPLYP (SEQ ID NO: 2148) |
| 1108E06 | 324 | 141 - 249 | 163 - 173 | 189 - 195 | 228 - 238 | 1 - 123 | 26 - 35 | 50 - 66 | 99 - 112 | SRDLLLFPHHGLDV (SEQ ID NO: 2151) |
| 1113E07 | 325 | 141 - 249 | 163 - 173 | 189 - 195 | 228 - 238 | 1 - 123 | 26 - 35 | 50 - 66 | 99 - 112 | SRDLLLFPHHSLDL (SEQ ID NO: 2152) |
| 1114G05 | 326 | 141 - 249 | 163 - 173 | 189 - 195 | 228 - 238 | 1 - 123 | 26 - 35 | 50 - 66 | 99 - 112 | SRDLLLFPHHSFDL (SEQ ID NO: 2147) |
| 1116A01 | 327 | 141 - 249 | 163 - 173 | 189 - 195 | 228 - 238 | 1 - 123 | 26 - 35 | 50 - 66 | 99 - 112 | SRDLLLFPHHALSP (SEQ ID NO: 2149) |
| 1116A09 | 328 | 141 - 249 | 163 - 173 | 189 - 195 | 228 - 238 | 1 - 123 | 26 - 35 | 50 - 66 | 99 - 112 | SRYLLLFPHHSFDL (SEQ ID NO: 2150) |
| 1116C11 | 329 | 141 - 249 | 163 - 173 | 189 - 195 | 228 - 238 | 1 - 123 | 26 - 35 | 50 - 66 | 99 - 112 | SRDLLLFPHHSFDL (SEQ ID NO: 2147) |

| | | | | | | | | | | |
|---|---|---|---|---|---|---|---|---|---|---|
| 1085A01 | 330 | 141 - 249 | 163 - 173 | 189 - 195 | 228 - 238 | 1 - 123 | 26 - 35 | 50 - 66 | 99 - 112 | SRDLLLFPHDHLLF (SEQ ID NO: 2602) |
| 1085A02 | 331 | 141 - 249 | 163 - 173 | 189 - 195 | 228 - 238 | 1 - 123 | 26 - 35 | 50 - 66 | 99 - 112 | SRDLLLFPSDPLGF (SEQ ID NO: 2639) |
| 1085A03 | 332 | 141 - 249 | 163 - 173 | 189 - 195 | 228 - 238 | 1 - 123 | 26 - 35 | 50 - 66 | 99 - 112 | SRDLLLFPTHPLSF (SEQ ID NO: 2561) |
| 1085A04 | 333 | 141 - 249 | 163 - 173 | 189 - 195 | 228 - 238 | 1 - 123 | 26 - 35 | 50 - 66 | 99 - 112 | SRDLLLFPLAPLFF (SEQ ID NO: 2550) |
| 1085A05 | 334 | 141 - 249 | 163 - 173 | 189 - 195 | 228 - 238 | 1 - 123 | 26 - 35 | 50 - 66 | 99 - 112 | SRDLLLFPSDPLSL (SEQ ID NO: 2659) |
| 1085A06 | 335 | 141 - 249 | 163 - 173 | 189 - 195 | 228 - 238 | 1 - 123 | 26 - 35 | 50 - 66 | 99 - 112 | SRDLLLFPSAPLSF (SEQ ID NO: 2611) |
| 1085A07 | 336 | 141 - 249 | 163 - 173 | 189 - 195 | 228 - 238 | 1 - 123 | 26 - 35 | 50 - 66 | 99 - 112 | SRDLLLFPASPLSF (SEQ ID NO: 2390) |
| 1085A09 | 337 | 140 - 248 | 162 - 172 | 188 - 194 | 227 - 237 | 1 - 122 | 26 - 35 | 50 - 66 | 99 - 111 | SRDLLLFPNDALS (SEQ ID NO: 2632) |
| 1085A10 | 338 | 141 - 249 | 163 - 173 | 189 - 195 | 228 - 238 | 1 - 123 | 26 - 35 | 50 - 66 | 99 - 112 | SRDLLLFPSAPLRF (SEQ ID NO: 2609) |
| 1085A11 | 339 | 140 - 248 | 162 - 172 | 188 - 194 | 227 - 237 | 1 - 122 | 26 - 35 | 50 - 66 | 99 - 111 | SRDLLLFPHDPLE (SEQ ID NO: 2363) |
| 1085B01 | 340 | 141 - 249 | 163 - 173 | 189 - 195 | 228 - 238 | 1 - 123 | 26 - 35 | 50 - 66 | 99 - 112 | SRDLLLFPQSPLYP (SEQ ID NO: 2466) |
| 1085B02 | 341 | 141 - 249 | 163 - 173 | 189 - 195 | 228 - 238 | 1 - 123 | 26 - 35 | 50 - 66 | 99 - 112 | SRDLLLFPHSSLVF (SEQ ID NO: 2392) |
| 1085B03 | 342 | 141 - 249 | 163 - 173 | 189 - 195 | 228 - 238 | 1 - 123 | 26 - 35 | 50 - 66 | 99 - 112 | SRDLLLFPYDPLLF (SEQ ID NO: 2638) |
| 1085B04 | 343 | 141 - 249 | 163 - 173 | 189 - 195 | 228 - 238 | 1 - 123 | 26 - 35 | 50 - 66 | 99 - 112 | SRDLLLFPHAPLYF (SEQ ID NO: 2589) |
| 1085B05 | 344 | 141 - 249 | 163 - 173 | 189 - 195 | 228 - 238 | 1 - 123 | 26 - 35 | 50 - 66 | 99 - 112 | SRDLLLFPHAPLSP (SEQ ID NO: 2573) |
| 1085B06 | 345 | 141 - 249 | 163 - 173 | 189 - 195 | 228 - 238 | 1 - 123 | 26 - 35 | 50 - 66 | 99 - 112 | SRDLLLFPLSPLSF (SEQ ID NO: 2574) |
| 1085B07 | 346 | 141 - 249 | 163 - 173 | 189 - 195 | 228 - 238 | 1 - 123 | 26 - 35 | 50 - 66 | 99 - 112 | SRDLLLFPDFPMAP (SEQ ID NO: 2433) |
| 1085B10 | 347 | 140 - 248 | 162 - 172 | 188 - 194 | 227 - 237 | 1 - 122 | 26 - 35 | 50 - 66 | 99 - 111 | SRDLLLFPHSPLY (SEQ ID NO: 2470) |
| 1085B12 | 348 | 141 - 249 | 163 - 173 | 189 - 195 | 228 - 238 | 1 - 123 | 26 - 35 | 50 - 66 | 99 - 112 | SRDLLLFPQDPLSP (SEQ ID NO: 2372) |
| 1085C02 | 349 | 141 - 249 | 163 - 173 | 189 - 195 | 228 - 238 | 1 - 123 | 26 - 35 | 50 - 66 | 99 - 112 | SRDLLLFPDDPLLS (SEQ ID NO: 2430) |
| 1085C03 | 350 | 141 - 249 | 163 - 173 | 189 - 195 | 228 - 238 | 1 - 123 | 26 - 35 | 50 - 66 | 99 - 112 | SRDLLLFPHGPLLI (SEQ ID NO: 2400) |
| 1085C05 | 351 | 141 - 249 | 163 - 173 | 189 - 195 | 228 - 238 | 1 - 123 | 26 - 35 | 50 - 66 | 99 - 112 | SRDLLLFPGSPLLF (SEQ ID NO: 2491) |
| 1085C06 | 352 | 141 - 249 | 163 - 173 | 189 - 195 | 228 - 238 | 1 - 123 | 26 - 35 | 50 - 66 | 99 - 112 | SRDLLLFPTAALSF (SEQ ID NO: 2341) |
| 1085C07 | 353 | 141 - 249 | 163 - 173 | 189 - 195 | 228 - 238 | 1 - 123 | 26 - 35 | 50 - 66 | 99 - 112 | SRDLLLFPHTPLRF (SEQ ID NO: 2375) |
| 1085C09 | 354 | 140 - 248 | 162 - 172 | 188 - 194 | 227 - 237 | 1 - 122 | 26 - 35 | 50 - 66 | 99 - 111 | SRDLLLFPHSPLT (SEQ ID NO: 2468) |
| 1085C10 | 355 | 141 - 249 | 163 - 173 | 189 - 195 | 228 - 238 | 1 - 123 | 26 - 35 | 50 - 66 | 99 - 112 | SRDLLLFPFSPLLF (SEQ ID NO: 2471) |
| 1085C12 | 356 | 141 - 249 | 163 - 173 | 189 - 195 | 228 - 238 | 1 - 123 | 26 - 35 | 50 - 66 | 99 - 112 | SRDLLLFPSHPLFF (SEQ ID NO: 2680) |
| 1085D01 | 357 | 141 - 249 | 163 - 173 | 189 - 195 | 228 - 238 | 1 - 123 | 26 - 35 | 50 - 66 | 99 - 112 | SRDLLLFPRPLLLF (SEQ ID NO: 2548) |
| 1085D02 | 358 | 141 - 249 | 163 - 173 | 189 - 195 | 228 - 238 | 1 - 123 | 26 - 35 | 50 - 66 | 99 - 112 | SRDLLLFPSQYLDF (SEQ ID NO: 2523) |
| 1085D03 | 359 | 141 - 249 | 163 - 173 | 189 - 195 | 228 - 238 | 1 - 123 | 26 - 35 | 50 - 66 | 99 - 112 | SRDLLLFPSSPLLF (SEQ ID NO: 2713) |
| 1085D04 | 360 | 141 - 249 | 163 - 173 | 189 - 195 | 228 - 238 | 1 - 123 | 26 - 35 | 50 - 66 | 99 - 112 | SRDLLLFPYFPLVF (SEQ ID NO: 2646) |
| 1085D06 | 361 | 141 - 249 | 163 - 173 | 189 - 195 | 228 - 238 | 1 - 123 | 26 - 35 | 50 - 66 | 99 - 112 | SRDLLLFPGSPLLD (SEQ ID NO: 2488) |
| 1085D07 | 362 | 141 - 249 | 163 - 173 | 189 - 195 | 228 - 238 | 1 - 123 | 26 - 35 | 50 - 66 | 99 - 112 | SRDLLLFPQAPLLF (SEQ ID NO: 2694) |
| 1085D08 | 363 | 141 - 249 | 163 - 173 | 189 - 195 | 228 - 238 | 1 - 123 | 26 - 35 | 50 - 66 | 99 - 112 | SRDLLLFPHSYLSP (SEQ ID NO: 2477) |
| 1085D09 | 364 | 141 - 249 | 163 - 173 | 189 - 195 | 228 - 238 | 1 - 123 | 26 - 35 | 50 - 66 | 99 - 112 | SRDLLLFPQTPLFP (SEQ ID NO: 2467) |
| 1085D10 | 365 | 141 - 249 | 163 - 173 | 189 - 195 | 228 - 238 | 1 - 123 | 26 - 35 | 50 - 66 | 99 - 112 | SRDLLLFPHSPLHP (SEQ ID NO: 2563) |
| 1085D11 | 366 | 141 - 249 | 163 - 173 | 189 - 195 | 228 - 238 | 1 - 123 | 26 - 35 | 50 - 66 | 99 - 112 | SRDLLLFPHAPLAP (SEQ ID NO: 2510) |
| 1085D12 | 367 | 141 - 249 | 163 - 173 | 189 - 195 | 228 - 238 | 1 - 123 | 26 - 35 | 50 - 66 | 99 - 112 | SRDLLLFPHTTLRF (SEQ ID NO: 2495) |
| 1085E01 | 368 | 141 - 249 | 163 - 173 | 189 - 195 | 228 - 238 | 1 - 123 | 26 - 35 | 50 - 66 | 99 - 112 | SRDLLLFPYAVLHF (SEQ ID NO: 2620) |
| 1085E02 | 369 | 141 - 249 | 163 - 173 | 189 - 195 | 228 - 238 | 1 - 123 | 26 - 35 | 50 - 66 | 99 - 112 | SRDLLLFPTSPLRL (SEQ ID NO: 2575) |
| 1085E07 | 370 | 141 - 249 | 163 - 173 | 189 - 195 | 228 - 238 | 1 - 123 | 26 - 35 | 50 - 66 | 99 - 112 | SRDLLLFPSDALSF (SEQ ID NO: 2568) |
| 1085E08 | 371 | 141 - 249 | 163 - 173 | 189 - 195 | 228 - 238 | 1 - 123 | 26 - 35 | 50 - 66 | 99 - 112 | SRDLLLFPNAPLDP (SEQ ID NO: 2603) |

| | | | | | | | | | | |
|---|---|---|---|---|---|---|---|---|---|---|
| 1085E09 | 372 | 141 - 249 | 163 - 173 | 189 - 195 | 228 - 238 | 1 - 123 | 26 - 35 | 50 - 66 | 99 - 112 | SRDLLLFPHDPPRF (SEQ ID NO: 2628) |
| 1085E10 | 373 | 141 - 249 | 163 - 173 | 189 - 195 | 228 - 238 | 1 - 123 | 26 - 35 | 50 - 66 | 99 - 112 | SRDLLLFPSEPLWP (SEQ ID NO: 2668) |
| 1085E11 | 374 | 141 - 249 | 163 - 173 | 189 - 195 | 228 - 238 | 1 - 123 | 26 - 35 | 50 - 66 | 99 - 112 | SRDLLLFPSSPLSN (SEQ ID NO: 2716) |
| 1085E12 | 375 | 141 - 249 | 163 - 173 | 189 - 195 | 228 - 238 | 1 - 123 | 26 - 35 | 50 - 66 | 99 - 112 | SRDLLLFPHLPLTP (SEQ ID NO: 2431) |
| 1085F01 | 376 | 141 - 249 | 163 - 173 | 189 - 195 | 228 - 238 | 1 - 123 | 26 - 35 | 50 - 66 | 99 - 112 | SRDLLLFPRSPLLF (SEQ ID NO: 2551) |
| 1085F02 | 377 | 141 - 249 | 163 - 173 | 189 - 195 | 228 - 238 | 1 - 123 | 26 - 35 | 50 - 66 | 99 - 112 | SRDLLLFPTSPLQL (SEQ ID NO: 2376) |
| 1085F03 | 378 | 141 - 249 | 163 - 173 | 189 - 195 | 228 - 238 | 1 - 123 | 26 - 35 | 50 - 66 | 99 - 112 | SRDLLLFPYTPLLF (SEQ ID NO: 2682) |
| 1085F04 | 379 | 141 - 249 | 163 - 173 | 189 - 195 | 228 - 238 | 1 - 123 | 26 - 35 | 50 - 66 | 99 - 112 | SRDLLLFPSSPLAF (SEQ ID NO: 2707) |
| 1085F05 | 380 | 141 - 249 | 163 - 173 | 189 - 195 | 228 - 238 | 1 - 123 | 26 - 35 | 50 - 66 | 99 - 112 | SRDLLLFPHDPLYF (SEQ ID NO: 2706) |
| 1085F06 | 381 | 141 - 249 | 163 - 173 | 189 - 195 | 228 - 238 | 1 - 123 | 26 - 35 | 50 - 66 | 99 - 112 | SRDLLLFPSAHLLF (SEQ ID NO: 2586) |
| 1085F07 | 382 | 141 - 249 | 163 - 173 | 189 - 195 | 228 - 238 | 1 - 123 | 26 - 35 | 50 - 66 | 99 - 112 | SRDLLLFPAGPLRF (SEQ ID NO: 2410) |
| 1085F09 | 383 | 141 - 249 | 163 - 173 | 189 - 195 | 228 - 238 | 1 - 123 | 26 - 35 | 50 - 66 | 99 - 112 | SRDLLLFPDHAFFV (SEQ ID NO: 2439) |
| 1085F10 | 384 | 141 - 249 | 163 - 173 | 189 - 195 | 228 - 238 | 1 - 123 | 26 - 35 | 50 - 66 | 99 - 112 | SRDLLLFPSDSGFA (SEQ ID NO: 2662) |
| 1085F11 | 385 | 141 - 249 | 163 - 173 | 189 - 195 | 228 - 238 | 1 - 123 | 26 - 35 | 50 - 66 | 99 - 112 | SRDLLLFPSSYLEF (SEQ ID NO: 2339) |
| 1085F12 | 386 | 141 - 249 | 163 - 173 | 189 - 195 | 228 - 238 | 1 - 123 | 26 - 35 | 50 - 66 | 99 - 112 | SRDLLLFPRDPLII (SEQ ID NO: 2558) |
| 1085G01 | 387 | 141 - 249 | 163 - 173 | 189 - 195 | 228 - 238 | 1 - 123 | 26 - 35 | 50 - 66 | 99 - 112 | SRDLLLFPSAPLHP (SEQ ID NO: 2605) |
| 1085G02 | 388 | 141 - 249 | 163 - 173 | 189 - 195 | 228 - 238 | 1 - 123 | 26 - 35 | 50 - 66 | 99 - 112 | SRDLLLFPNAPLLL (SEQ ID NO: 2613) |
| 1085G03 | 389 | 141 - 249 | 163 - 173 | 189 - 195 | 228 - 238 | 1 - 123 | 26 - 35 | 50 - 66 | 99 - 112 | SRDLLLFPAAPLLF (SEQ ID NO: 2403) |
| 1085G04 | 390 | 141 - 249 | 163 - 173 | 189 - 195 | 228 - 238 | 1 - 123 | 26 - 35 | 50 - 66 | 99 - 112 | SRDLLLFPSAPLDP (SEQ ID NO: 2601) |
| 1085G07 | 391 | 141 - 249 | 163 - 173 | 189 - 195 | 228 - 238 | 1 - 123 | 26 - 35 | 50 - 66 | 99 - 112 | SRDLLLFPNAVLDI (SEQ ID NO: 2629) |
| 1085G08 | 392 | 141 - 249 | 163 - 173 | 189 - 195 | 228 - 238 | 1 - 123 | 26 - 35 | 50 - 66 | 99 - 112 | SRDLLLFPSEPLFF (SEQ ID NO: 2664) |
| 1085G09 | 393 | 141 - 249 | 163 - 173 | 189 - 195 | 228 - 238 | 1 - 123 | 26 - 35 | 50 - 66 | 99 - 112 | SRDLLLFPSSVLWP (SEQ ID NO: 2338) |
| 1085G10 | 394 | 140 - 248 | 162 - 172 | 188 - 194 | 227 - 237 | 1 - 122 | 26 - 35 | 50 - 66 | 99 - 111 | SRDLLLFPHAPLQ (SEQ ID NO: 2554) |
| 1085G11 | 395 | 141 - 249 | 163 - 173 | 189 - 195 | 228 - 238 | 1 - 123 | 26 - 35 | 50 - 66 | 99 - 112 | SRDLLLFPDSPLAP (SEQ ID NO: 2445) |
| 1085G12 | 396 | 141 - 249 | 163 - 173 | 189 - 195 | 228 - 238 | 1 - 123 | 26 - 35 | 50 - 66 | 99 - 112 | SRDLLLFPSSPLHP (SEQ ID NO: 2576) |
| 1085H10 | 397 | 142 - 249 | 163 - 173 | 189 - 195 | 228 - 238 | 1 - 126 | 26 - 35 | 50 - 66 | 99 - 115 | DGYYDILTGYSYYGMDV (SEQ ID NO: 2135) |
| 1086A03 | 398 | 141 - 249 | 163 - 173 | 189 - 195 | 228 - 238 | 1 - 123 | 26 - 35 | 50 - 66 | 99 - 112 | SRDLLLFPSMPLTF (SEQ ID NO: 2695) |
| 1086A04 | 399 | 141 - 249 | 163 - 173 | 189 - 195 | 228 - 238 | 1 - 123 | 26 - 35 | 50 - 66 | 99 - 112 | SRDLLLFPHSILHP (SEQ ID NO: 2438) |
| 1086A05 | 400 | 141 - 249 | 163 - 173 | 189 - 195 | 228 - 238 | 1 - 123 | 26 - 35 | 50 - 66 | 99 - 112 | SRDLLLFPHAPLSH (SEQ ID NO: 2569) |
| 1086A07 | 401 | 141 - 249 | 163 - 173 | 189 - 195 | 228 - 238 | 1 - 123 | 26 - 35 | 50 - 66 | 99 - 112 | SRDLLLFPDAALRF (SEQ ID NO: 2421) |
| 1086A09 | 402 | 141 - 249 | 163 - 173 | 189 - 195 | 228 - 238 | 1 - 123 | 26 - 35 | 50 - 66 | 99 - 112 | SRDLLLFPSSHLSF (SEQ ID NO: 2704) |
| 1086A10 | 403 | 141 - 249 | 163 - 173 | 189 - 195 | 228 - 238 | 1 - 123 | 26 - 35 | 50 - 66 | 99 - 112 | SRDLLLFPSAPLSS (SEQ ID NO: 2624) |
| 1086A11 | 404 | 141 - 249 | 163 - 173 | 189 - 195 | 228 - 238 | 1 - 123 | 26 - 35 | 50 - 66 | 99 - 112 | SRDLLLFPHAPLTP (SEQ ID NO: 2577) |
| 1086A12 | 405 | 141 - 249 | 163 - 173 | 189 - 195 | 228 - 238 | 1 - 123 | 26 - 35 | 50 - 66 | 99 - 112 | SRDLLLFPYDPLHS (SEQ ID NO: 2635) |
| 1086B02 | 406 | 141 - 249 | 163 - 173 | 189 - 195 | 228 - 238 | 1 - 123 | 26 - 35 | 50 - 66 | 99 - 112 | SRDLLLFPHFPLHP (SEQ ID NO: 2348) |
| 1086B03 | 407 | 141 - 249 | 163 - 173 | 189 - 195 | 228 - 238 | 1 - 123 | 26 - 35 | 50 - 66 | 99 - 112 | SRDLLLFPAHPLLF (SEQ ID NO: 2412) |
| 1086B05 | 408 | 141 - 249 | 163 - 173 | 189 - 195 | 228 - 238 | 1 - 123 | 26 - 35 | 50 - 66 | 99 - 112 | SRDLLLFPFEPLII (SEQ ID NO: 2457) |
| 1086B06 | 409 | 141 - 249 | 163 - 173 | 189 - 195 | 228 - 238 | 1 - 123 | 26 - 35 | 50 - 66 | 99 - 112 | SRDLLLFPASPLNP (SEQ ID NO: 2364) |
| 1086B07 | 410 | 141 - 249 | 163 - 173 | 189 - 195 | 228 - 238 | 1 - 123 | 26 - 35 | 50 - 66 | 99 - 112 | SRDLLLFPSSPLYF (SEQ ID NO: 2720) |
| 1086B09 | 411 | 141 - 249 | 163 - 173 | 189 - 195 | 228 - 238 | 1 - 123 | 26 - 35 | 50 - 66 | 99 - 112 | SRDLLLFPTSPLSF (SEQ ID NO: 2579) |
| 1086B10 | 412 | 141 - 249 | 163 - 173 | 189 - 195 | 228 - 238 | 1 - 123 | 26 - 35 | 50 - 66 | 99 - 112 | SRDLLLFPDDGLSS (SEQ ID NO: 2428) |
| 1086B11 | 413 | 141 - 249 | 163 - 173 | 189 - 195 | 228 - 238 | 1 - 123 | 26 - 35 | 50 - 66 | 99 - 112 | SRDLLLFPISPLCF (SEQ ID NO: 2530) |

| | | | | | | | | | | |
|---|---|---|---|---|---|---|---|---|---|---|
| 1086C03 | 414 | 141 - 249 | 163 - 173 | 189 - 195 | 228 - 238 | 1 - 123 | 26 - 35 | 50 - 66 | 99 - 112 | SRDLLLFPTAPLYG (SEQ ID NO: 2535) |
| 1086C05 | 415 | 141 - 249 | 163 - 173 | 189 - 195 | 228 - 238 | 1 - 123 | 26 - 35 | 50 - 66 | 99 - 112 | SRDLLLFPHHSLFF (SEQ ID NO: 2427) |
| 1086C07 | 416 | 141 - 249 | 163 - 173 | 189 - 195 | 228 - 238 | 1 - 123 | 26 - 35 | 50 - 66 | 99 - 112 | SRDLLLFPQGPLRF (SEQ ID NO: 2440) |
| 1086C08 | 417 | 141 - 249 | 163 - 173 | 189 - 195 | 228 - 238 | 1 - 123 | 26 - 35 | 50 - 66 | 99 - 112 | SRDLLLFPAAPLAF (SEQ ID NO: 2401) |
| 1086C09 | 418 | 141 - 249 | 163 - 173 | 189 - 195 | 228 - 238 | 1 - 123 | 26 - 35 | 50 - 66 | 99 - 112 | SRDLLLFPHLPLLF (SEQ ID NO: 2350) |
| 1086C10 | 419 | 141 - 249 | 163 - 173 | 189 - 195 | 228 - 238 | 1 - 123 | 26 - 35 | 50 - 66 | 99 - 112 | SRDLLLFPTFPLIF (SEQ ID NO: 2541) |
| 1086C11 | 420 | 141 - 249 | 163 - 173 | 189 - 195 | 228 - 238 | 1 - 123 | 26 - 35 | 50 - 66 | 99 - 112 | SRDLLLFPDDPLSF (SEQ ID NO: 2432) |
| 1086C12 | 421 | 141 - 249 | 163 - 173 | 189 - 195 | 228 - 238 | 1 - 123 | 26 - 35 | 50 - 66 | 99 - 112 | SRDLLLFPTDSLLF (SEQ ID NO: 2622) |
| 1086D01 | 422 | 141 - 249 | 163 - 173 | 189 - 195 | 228 - 238 | 1 - 123 | 26 - 35 | 50 - 66 | 99 - 112 | SRDLLLFPSAPLTP (SEQ ID NO: 2630) |
| 1086D04 | 423 | 141 - 249 | 163 - 173 | 189 - 195 | 228 - 238 | 1 - 123 | 26 - 35 | 50 - 66 | 99 - 112 | SRYLLLFPYAPLYD (SEQ ID NO: 2697) |
| 1086D05 | 424 | 141 - 249 | 163 - 173 | 189 - 195 | 228 - 238 | 1 - 123 | 26 - 35 | 50 - 66 | 99 - 112 | SRDLLLFPHSPLSF (SEQ ID NO: 2461) |
| 1086D06 | 425 | 141 - 249 | 163 - 173 | 189 - 195 | 228 - 238 | 1 - 123 | 26 - 35 | 50 - 66 | 99 - 112 | SRDLLLFPTAPLDL (SEQ ID NO: 2379) |
| 1086D07 | 426 | 141 - 249 | 163 - 173 | 189 - 195 | 228 - 238 | 1 - 123 | 26 - 35 | 50 - 66 | 99 - 112 | SRDLLLFPHTHLTF (SEQ ID NO: 2365) |
| 1086D08 | 427 | 141 - 249 | 163 - 173 | 189 - 195 | 228 - 238 | 1 - 123 | 26 - 35 | 50 - 66 | 99 - 112 | SRDLLLFPHSSLDF (SEQ ID NO: 2473) |
| 1086D09 | 428 | 141 - 249 | 163 - 173 | 189 - 195 | 228 - 238 | 1 - 123 | 26 - 35 | 50 - 66 | 99 - 112 | SRDLLLFPNHPMFP (SEQ ID NO: 2665) |
| 1086D10 | 429 | 141 - 249 | 163 - 173 | 189 - 195 | 228 - 238 | 1 - 123 | 26 - 35 | 50 - 66 | 99 - 112 | SRDLLLFPLSSLEF (SEQ ID NO: 2587) |
| 1086D11 | 430 | 141 - 249 | 163 - 173 | 189 - 195 | 228 - 238 | 1 - 123 | 26 - 35 | 50 - 66 | 99 - 112 | SRDLLLFPNAPLHP (SEQ ID NO: 2610) |
| 1086D12 | 431 | 141 - 249 | 163 - 173 | 189 - 195 | 228 - 238 | 1 - 123 | 26 - 35 | 50 - 66 | 99 - 112 | SRDLLLFPRAHLRF (SEQ ID NO: 2469) |
| 1086E02 | 432 | 141 - 249 | 163 - 173 | 189 - 195 | 228 - 238 | 1 - 123 | 26 - 35 | 50 - 66 | 99 - 112 | SRDLLLFPYDPLHF (SEQ ID NO: 2621) |
| 1086E03 | 433 | 141 - 249 | 163 - 173 | 189 - 195 | 228 - 238 | 1 - 123 | 26 - 35 | 50 - 66 | 99 - 112 | SRDLLLFPHDALQS (SEQ ID NO: 2598) |
| 1086E05 | 434 | 141 - 249 | 163 - 173 | 189 - 195 | 228 - 238 | 1 - 123 | 26 - 35 | 50 - 66 | 99 - 112 | SRDLLLFPRTPLTF (SEQ ID NO: 2567) |
| 1086E07 | 435 | 141 - 249 | 163 - 173 | 189 - 195 | 228 - 238 | 1 - 123 | 26 - 35 | 50 - 66 | 99 - 112 | SRDLLLFPAAHLSF (SEQ ID NO: 2398) |
| 1086E08 | 436 | 141 - 249 | 163 - 173 | 189 - 195 | 228 - 238 | 1 - 123 | 26 - 35 | 50 - 66 | 99 - 112 | SRDLLLFPRAPLLF (SEQ ID NO: 2490) |
| 1086E09 | 437 | 141 - 249 | 163 - 173 | 189 - 195 | 228 - 238 | 1 - 123 | 26 - 35 | 50 - 66 | 99 - 112 | SRDLLLFPFSPLAP (SEQ ID NO: 2464) |
| 1086E10 | 438 | 141 - 249 | 163 - 173 | 189 - 195 | 228 - 238 | 1 - 123 | 26 - 35 | 50 - 66 | 99 - 112 | SRDLLLFPRAPLDF (SEQ ID NO: 2367) |
| 1086E12 | 439 | 141 - 249 | 163 - 173 | 189 - 195 | 228 - 238 | 1 - 123 | 26 - 35 | 50 - 66 | 99 - 112 | SRDLLLFPTAPLRF (SEQ ID NO: 2522) |
| 1086F02 | 440 | 141 - 249 | 163 - 173 | 189 - 195 | 228 - 238 | 1 - 123 | 26 - 35 | 50 - 66 | 99 - 112 | SRDLLLFPSSPLRI (SEQ ID NO: 2714) |
| 1086F05 | 441 | 141 - 249 | 163 - 173 | 189 - 195 | 228 - 238 | 1 - 123 | 26 - 35 | 50 - 66 | 99 - 112 | SRDLLLFPTEPLQF (SEQ ID NO: 2540) |
| 1086F08 | 442 | 141 - 249 | 163 - 173 | 189 - 195 | 228 - 238 | 1 - 123 | 26 - 35 | 50 - 66 | 99 - 112 | SRDLLLFPSDPLSA (SEQ ID NO: 2643) |
| 1086F09 | 443 | 141 - 249 | 163 - 173 | 189 - 195 | 228 - 238 | 1 - 123 | 26 - 35 | 50 - 66 | 99 - 112 | SRDLLLFPYNPPIF (SEQ ID NO: 2653) |
| 1086F11 | 444 | 141 - 249 | 163 - 173 | 189 - 195 | 228 - 238 | 1 - 123 | 26 - 35 | 50 - 66 | 99 - 112 | SRDLLLFPHTPLLF (SEQ ID NO: 2489) |
| 1086G03 | 445 | 141 - 249 | 163 - 173 | 189 - 195 | 228 - 238 | 1 - 123 | 26 - 35 | 50 - 66 | 99 - 112 | SRDLLLFPHAPLDL (SEQ ID NO: 2513) |
| 1086G04 | 446 | 141 - 249 | 163 - 173 | 189 - 195 | 228 - 238 | 1 - 123 | 26 - 35 | 50 - 66 | 99 - 112 | SRDLLLFPFDPLLI (SEQ ID NO: 2454) |
| 1086G05 | 447 | 141 - 249 | 163 - 173 | 189 - 195 | 228 - 238 | 1 - 123 | 26 - 35 | 50 - 66 | 99 - 112 | SRDLLLFPTDALRI (SEQ ID NO: 2537) |
| 1086G06 | 448 | 141 - 249 | 163 - 173 | 189 - 195 | 228 - 238 | 1 - 123 | 26 - 35 | 50 - 66 | 99 - 112 | SRDLLLFPAAPLTP (SEQ ID NO: 2407) |
| 1086G07 | 449 | 141 - 249 | 163 - 173 | 189 - 195 | 228 - 238 | 1 - 123 | 26 - 35 | 50 - 66 | 99 - 112 | SRDLLLFPEGPLLF (SEQ ID NO: 2448) |
| 1086G09 | 450 | 141 - 249 | 163 - 173 | 189 - 195 | 228 - 238 | 1 - 123 | 26 - 35 | 50 - 66 | 99 - 112 | SRDLLLFPYAPLSF (SEQ ID NO: 2385) |
| 1086G10 | 451 | 141 - 249 | 163 - 173 | 189 - 195 | 228 - 238 | 1 - 123 | 26 - 35 | 50 - 66 | 99 - 112 | SRDLLLFPADSLSF (SEQ ID NO: 2391) |
| 1086H05 | 452 | 141 - 249 | 163 - 173 | 189 - 195 | 228 - 238 | 1 - 123 | 26 - 35 | 50 - 66 | 99 - 112 | SRDLLLFPYSPLTH (SEQ ID NO: 2679) |
| 1089A01 | 453 | 140 - 248 | 162 - 172 | 188 - 194 | 227 - 237 | 1 - 122 | 26 - 35 | 50 - 66 | 99 - 111 | SRDLLLFPHDPLI (SEQ ID NO: 2512) |
| 1089A03 | 454 | 141 - 249 | 163 - 173 | 189 - 195 | 228 - 238 | 1 - 123 | 26 - 35 | 50 - 66 | 99 - 112 | SRDLLLFPLTPLLI (SEQ ID NO: 2590) |
| 1089A06 | 455 | 141 - 249 | 163 - 173 | 189 - 195 | 228 - 238 | 1 - 123 | 26 - 35 | 50 - 66 | 99 - 112 | SRDLLLFPHTPLHF (SEQ ID NO: 2485) |

| | | | | | | | | | | |
|---|---|---|---|---|---|---|---|---|---|---|
| 1089A07 | 456 | 141 - 249 | 163 - 173 | 189 - 195 | 228 - 238 | 1 - 123 | 26 - 35 | 50 - 66 | 99 - 112 | SRDLLLFPTDALYF (SEQ ID NO: 2539) |
| 1089A08 | 457 | 141 - 249 | 163 - 173 | 189 - 195 | 228 - 238 | 1 - 123 | 26 - 35 | 50 - 66 | 99 - 112 | SRDLLLFPYTPLLF (SEQ ID NO: 2682) |
| 1089A10 | 458 | 141 - 249 | 163 - 173 | 189 - 195 | 228 - 238 | 1 - 123 | 26 - 35 | 50 - 66 | 99 - 112 | SRDLLLFPHQPLTF (SEQ ID NO: 2436) |
| 1089A11 | 459 | 141 - 249 | 163 - 173 | 189 - 195 | 228 - 238 | 1 - 123 | 26 - 35 | 50 - 66 | 99 - 112 | SRDLLLFPRTYLDF (SEQ ID NO: 2572) |
| 1089B01 | 460 | 141 - 249 | 163 - 173 | 189 - 195 | 228 - 238 | 1 - 123 | 26 - 35 | 50 - 66 | 99 - 112 | SRDLLLFPHSPLHS (SEQ ID NO: 2450) |
| 1089B02 | 461 | 141 - 249 | 163 - 173 | 189 - 195 | 228 - 238 | 1 - 123 | 26 - 35 | 50 - 66 | 99 - 112 | SRDLLLFPHHSFDL (SEQ ID NO: 2147) |
| 1089B03 | 462 | 141 - 249 | 163 - 173 | 189 - 195 | 228 - 238 | 1 - 123 | 26 - 35 | 50 - 66 | 99 - 112 | SRDLLLFPTSPLQP (SEQ ID NO: 2528) |
| 1089B04 | 463 | 141 - 249 | 163 - 173 | 189 - 195 | 228 - 238 | 1 - 123 | 26 - 35 | 50 - 66 | 99 - 112 | SRDLLLFPTHPLLF (SEQ ID NO: 2556) |
| 1089B05 | 464 | 141 - 249 | 163 - 173 | 189 - 195 | 228 - 238 | 1 - 123 | 26 - 35 | 50 - 66 | 99 - 112 | SRDLLLFPSSPLIF (SEQ ID NO: 2712) |
| 1089B06 | 465 | 141 - 249 | 163 - 173 | 189 - 195 | 228 - 238 | 1 - 123 | 26 - 35 | 50 - 66 | 99 - 112 | SRDLLLFPMAPLSP (SEQ ID NO: 2596) |
| 1089B07 | 466 | 141 - 249 | 163 - 173 | 189 - 195 | 228 - 238 | 1 - 123 | 26 - 35 | 50 - 66 | 99 - 112 | SRDLLLFPYSGLDA (SEQ ID NO: 2374) |
| 1089B08 | 467 | 141 - 249 | 163 - 173 | 189 - 195 | 228 - 238 | 1 - 123 | 26 - 35 | 50 - 66 | 99 - 112 | SRDLLLFPAAPLSP (SEQ ID NO: 2405) |
| 1089B09 | 468 | 141 - 249 | 163 - 173 | 189 - 195 | 228 - 238 | 1 - 123 | 26 - 35 | 50 - 66 | 99 - 112 | SRDLLLFPKSPILF (SEQ ID NO: 2384) |
| 1089B10 | 469 | 141 - 249 | 163 - 173 | 189 - 195 | 228 - 238 | 1 - 123 | 26 - 35 | 50 - 66 | 99 - 112 | SRDLLLFPTSPLFF (SEQ ID NO: 2571) |
| 1089B11 | 470 | 141 - 249 | 163 - 173 | 189 - 195 | 228 - 238 | 1 - 123 | 26 - 35 | 50 - 66 | 99 - 112 | SRDLLLFPNSPLFP (SEQ ID NO: 2388) |
| 1089C01 | 471 | 141 - 249 | 163 - 173 | 189 - 195 | 228 - 238 | 1 - 123 | 26 - 35 | 50 - 66 | 99 - 112 | SRDLLLFPHYGMDV (SEQ ID NO: 2133) |
| 1089C02 | 472 | 141 - 249 | 163 - 173 | 189 - 195 | 228 - 238 | 1 - 123 | 26 - 35 | 50 - 66 | 99 - 112 | SRDLLLFPRSPLLF (SEQ ID NO: 2551) |
| 1089C03 | 473 | 141 - 249 | 163 - 173 | 189 - 195 | 228 - 238 | 1 - 123 | 26 - 35 | 50 - 66 | 99 - 112 | SRDLLLFPYHPLLF (SEQ ID NO: 2532) |
| 1089C05 | 474 | 141 - 249 | 163 - 173 | 189 - 195 | 228 - 238 | 1 - 123 | 26 - 35 | 50 - 66 | 99 - 112 | SRDLLLFPSSALRF (SEQ ID NO: 2722) |
| 1089C06 | 475 | 141 - 249 | 163 - 173 | 189 - 195 | 228 - 238 | 1 - 123 | 26 - 35 | 50 - 66 | 99 - 112 | SRDLLLFPSPYLSF (SEQ ID NO: 2701) |
| 1089C07 | 476 | 141 - 249 | 163 - 173 | 189 - 195 | 228 - 238 | 1 - 123 | 26 - 35 | 50 - 66 | 99 - 112 | SRDLLLFPQAPLFD (SEQ ID NO: 2683) |
| 1089C09 | 477 | 141 - 249 | 163 - 173 | 189 - 195 | 228 - 238 | 1 - 123 | 26 - 35 | 50 - 66 | 99 - 112 | SRDLLLFPHAPFTF (SEQ ID NO: 2507) |
| 1089D01 | 478 | 141 - 249 | 163 - 173 | 189 - 195 | 228 - 238 | 1 - 123 | 26 - 35 | 50 - 66 | 99 - 112 | SRDLLLFPHAPLVL (SEQ ID NO: 2581) |
| 1089D02 | 479 | 141 - 249 | 163 - 173 | 189 - 195 | 228 - 238 | 1 - 123 | 26 - 35 | 50 - 66 | 99 - 112 | SRDLLLFPHYGMDV (SEQ ID NO: 2133) |
| 1089D03 | 480 | 141 - 249 | 163 - 173 | 189 - 195 | 228 - 238 | 1 - 123 | 26 - 35 | 50 - 66 | 99 - 112 | SRDLLLFPHYPLLF (SEQ ID NO: 2344) |
| 1089D04 | 481 | 141 - 249 | 163 - 173 | 189 - 195 | 228 - 238 | 1 - 123 | 26 - 35 | 50 - 66 | 99 - 112 | SRDLLLFPSSPLSP (SEQ ID NO: 2717) |
| 1089D05 | 482 | 141 - 249 | 163 - 173 | 189 - 195 | 228 - 238 | 1 - 123 | 26 - 35 | 50 - 66 | 99 - 112 | SRDLLLFPHAPLFT (SEQ ID NO: 2546) |
| 1089D07 | 483 | 141 - 249 | 163 - 173 | 189 - 195 | 228 - 238 | 1 - 123 | 26 - 35 | 50 - 66 | 99 - 112 | SRDLLLFPNDPLLI (SEQ ID NO: 2634) |
| 1089D08 | 484 | 140 - 248 | 162 - 172 | 188 - 194 | 227 - 237 | 1 - 122 | 26 - 35 | 50 - 66 | 99 - 111 | SRDLLLFPHAPLQ (SEQ ID NO: 2554) |
| 1089D09 | 485 | 141 - 249 | 163 - 173 | 189 - 195 | 228 - 238 | 1 - 123 | 26 - 35 | 50 - 66 | 99 - 112 | SRDLLLFPSHAFHE (SEQ ID NO: 2677) |
| 1089D11 | 486 | 141 - 249 | 163 - 173 | 189 - 195 | 228 - 238 | 1 - 123 | 26 - 35 | 50 - 66 | 99 - 112 | SRDLLLFPNHPLYP (SEQ ID NO: 2663) |
| 1089E01 | 487 | 141 - 249 | 163 - 173 | 189 - 195 | 228 - 238 | 1 - 123 | 26 - 35 | 50 - 66 | 99 - 112 | SRDLLLFPYSPLFP (SEQ ID NO: 2657) |
| 1089E02 | 488 | 141 - 249 | 163 - 173 | 189 - 195 | 228 - 238 | 1 - 123 | 26 - 35 | 50 - 66 | 99 - 112 | SRDLLLFPQDPLHP (SEQ ID NO: 2346) |
| 1089E03 | 489 | 141 - 249 | 163 - 173 | 189 - 195 | 228 - 238 | 1 - 123 | 26 - 35 | 50 - 66 | 99 - 112 | SRDLLLFPDAPLFP (SEQ ID NO: 2423) |
| 1089E04 | 490 | 141 - 249 | 163 - 173 | 189 - 195 | 228 - 238 | 1 - 123 | 26 - 35 | 50 - 66 | 99 - 112 | SRDLLLFPHSPLLI (SEQ ID NO: 2453) |
| 1089E06 | 491 | 141 - 249 | 163 - 173 | 189 - 195 | 228 - 238 | 1 - 123 | 26 - 35 | 50 - 66 | 99 - 112 | SRDLLLFPGSPLLF (SEQ ID NO: 2491) |
| 1089E09 | 492 | 141 - 249 | 163 - 173 | 189 - 195 | 228 - 238 | 1 - 123 | 26 - 35 | 50 - 66 | 99 - 112 | SRDLLLFPSSPLTF (SEQ ID NO: 2718) |
| 1089E10 | 493 | 141 - 249 | 163 - 173 | 189 - 195 | 228 - 238 | 1 - 123 | 26 - 35 | 50 - 66 | 99 - 112 | SRDLLLFPTQPLSP (SEQ ID NO: 2566) |
| 1089E11 | 494 | 141 - 249 | 163 - 173 | 189 - 195 | 228 - 238 | 1 - 123 | 26 - 35 | 50 - 66 | 99 - 112 | SRDLLLFPLSPLWP (SEQ ID NO: 2578) |
| 1089F01 | 495 | 141 - 249 | 163 - 173 | 189 - 195 | 228 - 238 | 1 - 123 | 26 - 35 | 50 - 66 | 99 - 112 | SRDLLLFPTFPLLF (SEQ ID NO: 2380) |
| 1089F03 | 496 | 141 - 249 | 163 - 173 | 189 - 195 | 228 - 238 | 1 - 123 | 26 - 35 | 50 - 66 | 99 - 112 | SRDLLLFPHDPLLL (SEQ ID NO: 2580) |
| 1089F04 | 497 | 141 - 249 | 163 - 173 | 189 - 195 | 228 - 238 | 1 - 123 | 26 - 35 | 50 - 66 | 99 - 112 | SRDLLLFPYSPLLF (SEQ ID NO: 2670) |

| | | | | | | | | | | |
|---|---|---|---|---|---|---|---|---|---|---|
| 1089F05 | 498 | 141 - 249 | 163 - 173 | 189 - 195 | 228 - 238 | 1 - 123 | 26 - 35 | 50 - 66 | 99 - 112 | SRDLLLFPHSPLRI (SEQ ID NO: 2459) |
| 1089F06 | 499 | 141 - 249 | 163 - 173 | 189 - 195 | 228 - 238 | 1 - 123 | 26 - 35 | 50 - 66 | 99 - 112 | SRDLLLFPRAPLLF (SEQ ID NO: 2490) |
| 1089F08 | 500 | 141 - 249 | 163 - 173 | 189 - 195 | 228 - 238 | 1 - 123 | 26 - 35 | 50 - 66 | 99 - 112 | SRDLLLFPRTPLTF (SEQ ID NO: 2567) |
| 1089F09 | 501 | 141 - 249 | 163 - 173 | 189 - 195 | 228 - 238 | 1 - 123 | 26 - 35 | 50 - 66 | 99 - 112 | SRDLLLFPLAPLSF (SEQ ID NO: 2555) |
| 1089F10 | 502 | 141 - 249 | 163 - 173 | 189 - 195 | 228 - 238 | 1 - 123 | 26 - 35 | 50 - 66 | 99 - 112 | SRDLLLFPNQPLSF (SEQ ID NO: 2667) |
| 1089F11 | 503 | 141 - 249 | 163 - 173 | 189 - 195 | 228 - 238 | 1 - 123 | 26 - 35 | 50 - 66 | 99 - 112 | SRDLLLFPLEPMHF (SEQ ID NO: 2565) |
| 1089G01 | 504 | 141 - 249 | 163 - 173 | 189 - 195 | 228 - 238 | 1 - 123 | 26 - 35 | 50 - 66 | 99 - 112 | SRDLLLFPSAPLTF (SEQ ID NO: 2626) |
| 1089G02 | 505 | 141 - 249 | 163 - 173 | 189 - 195 | 228 - 238 | 1 - 123 | 26 - 35 | 50 - 66 | 99 - 112 | SRDLLLFPSHPLLF (SEQ ID NO: 2687) |
| 1089G03 | 506 | 141 - 249 | 163 - 173 | 189 - 195 | 228 - 238 | 1 - 123 | 26 - 35 | 50 - 66 | 99 - 112 | SRDLLLFPRTPLVF (SEQ ID NO: 2721) |
| 1089G05 | 507 | 141 - 249 | 163 - 173 | 189 - 195 | 228 - 238 | 1 - 123 | 26 - 35 | 50 - 66 | 99 - 112 | SRDLLLFPGSPLTF (SEQ ID NO: 2389) |
| 1089G06 | 508 | 141 - 249 | 163 - 173 | 189 - 195 | 228 - 238 | 1 - 123 | 26 - 35 | 50 - 66 | 99 - 112 | SRDLLLFPTAPLLF (SEQ ID NO: 2514) |
| 1089G07 | 509 | 141 - 249 | 163 - 173 | 189 - 195 | 228 - 238 | 1 - 123 | 26 - 35 | 50 - 66 | 99 - 112 | SRDLLLFPSAPLDF (SEQ ID NO: 2597) |
| 1089G08 | 510 | 141 - 249 | 163 - 173 | 189 - 195 | 228 - 238 | 1 - 123 | 26 - 35 | 50 - 66 | 99 - 112 | SRDLLLFPSHPLSF (SEQ ID NO: 2688) |
| 1089G11 | 511 | 141 - 249 | 163 - 173 | 189 - 195 | 228 - 238 | 1 - 123 | 26 - 35 | 50 - 66 | 99 - 112 | SRDLLLFPSFPLLF (SEQ ID NO: 2671) |
| 1089H10 | 512 | 142 - 249 | 163 - 173 | 189 - 195 | 228 - 238 | 1 - 126 | 26 - 35 | 50 - 66 | 99 - 115 | DGYYDILTGYSYYGMDV (SEQ ID NO: 2135) |
| 1090A02 | 513 | 141 - 249 | 163 - 173 | 189 - 195 | 228 - 238 | 1 - 123 | 26 - 35 | 50 - 66 | 99 - 112 | SRDLLLFPAKPLLF (SEQ ID NO: 2416) |
| 1090A03 | 514 | 141 - 249 | 163 - 173 | 189 - 195 | 228 - 238 | 1 - 123 | 26 - 35 | 50 - 66 | 99 - 112 | SRDLLLFPNSTLSF (SEQ ID NO: 2678) |
| 1090A04 | 515 | 141 - 249 | 163 - 173 | 189 - 195 | 228 - 238 | 1 - 123 | 26 - 35 | 50 - 66 | 99 - 112 | SRDLLLFPDAPLTP (SEQ ID NO: 2426) |
| 1090A05 | 516 | 141 - 249 | 163 - 173 | 189 - 195 | 228 - 238 | 1 - 123 | 26 - 35 | 50 - 66 | 99 - 112 | SRDLLLFPHEPLLI (SEQ ID NO: 2648) |
| 1090A06 | 517 | 141 - 249 | 163 - 173 | 189 - 195 | 228 - 238 | 1 - 123 | 26 - 35 | 50 - 66 | 99 - 112 | SRDLLLFPTYPLSF (SEQ ID NO: 2600) |
| 1090A07 | 518 | 141 - 249 | 163 - 173 | 189 - 195 | 228 - 238 | 1 - 123 | 26 - 35 | 50 - 66 | 99 - 112 | SRDLLLFPTEPLVL (SEQ ID NO: 2479) |
| 1090A08 | 519 | 141 - 249 | 163 - 173 | 189 - 195 | 228 - 238 | 1 - 123 | 26 - 35 | 50 - 66 | 99 - 112 | SRDLLLFPTYPLHF (SEQ ID NO: 2584) |
| 1090B01 | 520 | 141 - 249 | 163 - 173 | 189 - 195 | 228 - 238 | 1 - 123 | 26 - 35 | 50 - 66 | 99 - 112 | SRDLLLFPHDPLTF (SEQ ID NO: 2627) |
| 1090B03 | 521 | 141 - 249 | 163 - 173 | 189 - 195 | 228 - 238 | 1 - 123 | 26 - 35 | 50 - 66 | 99 - 112 | SRDLLLFPQAPLTN (SEQ ID NO: 2705) |
| 1090B04 | 522 | 141 - 249 | 163 - 173 | 189 - 195 | 228 - 238 | 1 - 123 | 26 - 35 | 50 - 66 | 99 - 112 | SRDLLLFPHAPLEA (SEQ ID NO: 2520) |
| 1090B05 | 523 | 141 - 249 | 163 - 173 | 189 - 195 | 228 - 238 | 1 - 123 | 26 - 35 | 50 - 66 | 99 - 112 | SRDLLLFPDHPLLF (SEQ ID NO: 2442) |
| 1090B06 | 524 | 141 - 249 | 163 - 173 | 189 - 195 | 228 - 238 | 1 - 123 | 26 - 35 | 50 - 66 | 99 - 112 | SRDLLLFPRAPLSF (SEQ ID NO: 2496) |
| 1090B08 | 525 | 141 - 249 | 163 - 173 | 189 - 195 | 228 - 238 | 1 - 123 | 26 - 35 | 50 - 66 | 99 - 112 | SRDLLLFPRGPLRF (SEQ ID NO: 2542) |
| 1090B11 | 526 | 141 - 249 | 163 - 173 | 189 - 195 | 228 - 238 | 1 - 123 | 26 - 35 | 50 - 66 | 99 - 112 | SRDLLLFPFTPLTF (SEQ ID NO: 2474) |
| 1090B12 | 527 | 141 - 249 | 163 - 173 | 189 - 195 | 228 - 238 | 1 - 123 | 26 - 35 | 50 - 66 | 99 - 112 | SRDLLLFPQHPLSP (SEQ ID NO: 2452) |
| 1090C01 | 528 | 141 - 249 | 163 - 173 | 189 - 195 | 228 - 238 | 1 - 123 | 26 - 35 | 50 - 66 | 99 - 112 | SRDLLLFPSAPIVF (SEQ ID NO: 2591) |
| 1090C02 | 529 | 141 - 249 | 163 - 173 | 189 - 195 | 228 - 238 | 1 - 123 | 26 - 35 | 50 - 66 | 99 - 112 | SRDLLLFPQAPLTF (SEQ ID NO: 2702) |
| 1090C03 | 530 | 141 - 249 | 163 - 173 | 189 - 195 | 228 - 238 | 1 - 123 | 26 - 35 | 50 - 66 | 99 - 112 | SRDLLLFPRAPLRF (SEQ ID NO: 2493) |
| 1090C05 | 531 | 141 - 249 | 163 - 173 | 189 - 195 | 228 - 238 | 1 - 123 | 26 - 35 | 50 - 66 | 99 - 112 | SRDLLLFPRTPLTF (SEQ ID NO: 2567) |
| 1090C06 | 532 | 141 - 249 | 163 - 173 | 189 - 195 | 228 - 238 | 1 - 123 | 26 - 35 | 50 - 66 | 99 - 112 | SRDLLLFPHAPLDF (SEQ ID NO: 2538) |
| 1090C07 | 533 | 141 - 249 | 163 - 173 | 189 - 195 | 228 - 238 | 1 - 123 | 26 - 35 | 50 - 66 | 99 - 112 | SRDLLLFPHAGFDS (SEQ ID NO: 2498) |
| 1090C08 | 534 | 141 - 249 | 163 - 173 | 189 - 195 | 228 - 238 | 1 - 123 | 26 - 35 | 50 - 66 | 99 - 112 | SRDLLLFPYSPLSF (SEQ ID NO: 2676) |
| 1090C10 | 535 | 141 - 249 | 163 - 173 | 189 - 195 | 228 - 238 | 1 - 123 | 26 - 35 | 50 - 66 | 99 - 112 | SRDLLLFPGRPLTF (SEQ ID NO: 2358) |
| 1090D02 | 536 | 141 - 249 | 163 - 173 | 189 - 195 | 228 - 238 | 1 - 123 | 26 - 35 | 50 - 66 | 99 - 112 | SRDLLLFPAEHLLF (SEQ ID NO: 2408) |
| 1090D03 | 537 | 141 - 249 | 163 - 173 | 189 - 195 | 228 - 238 | 1 - 123 | 26 - 35 | 50 - 66 | 99 - 112 | SRDLLLFPTAPLHP (SEQ ID NO: 2351) |
| 1090D04 | 538 | 141 - 249 | 163 - 173 | 189 - 195 | 228 - 238 | 1 - 123 | 26 - 35 | 50 - 66 | 99 - 112 | SRDLLLFPHEPLTA (SEQ ID NO: 2654) |
| 1090D05 | 539 | 141 - 249 | 163 - 173 | 189 - 195 | 228 - 238 | 1 - 123 | 26 - 35 | 50 - 66 | 99 - 112 | SRDLLLFPHAPLFE (SEQ ID NO: 2529) |

| | | | | | | | | | | |
|---|---|---|---|---|---|---|---|---|---|---|
| I090D06 | 540 | 141 - 249 | 163 - 173 | 189 - 195 | 228 - 238 | 1 - 123 | 26 - 35 | 50 - 66 | 99 - 112 | SRDLLLFPRAPLDF (SEQ ID NO: 2367) |
| I090D07 | 541 | 141 - 249 | 163 - 173 | 189 - 195 | 228 - 238 | 1 - 123 | 26 - 35 | 50 - 66 | 99 - 112 | SRDLLLFPFGTLRF (SEQ ID NO: 2462) |
| I090D08 | 542 | 141 - 249 | 163 - 173 | 189 - 195 | 228 - 238 | 1 - 123 | 26 - 35 | 50 - 66 | 99 - 112 | SRDLLLFPSSPLVF (SEQ ID NO: 2723) |
| I090D09 | 543 | 141 - 249 | 163 - 173 | 189 - 195 | 228 - 238 | 1 - 123 | 26 - 35 | 50 - 66 | 99 - 112 | SRDLLLFPRDPLAF (SEQ ID NO: 2505) |
| I090D12 | 544 | 141 - 249 | 163 - 173 | 189 - 195 | 228 - 238 | 1 - 123 | 26 - 35 | 50 - 66 | 99 - 112 | SRDLLLFPTSPLSF (SEQ ID NO: 2579) |
| I090E04 | 545 | 141 - 249 | 163 - 173 | 189 - 195 | 228 - 238 | 1 - 123 | 26 - 35 | 50 - 66 | 99 - 112 | SRDLLLFPHAPLLL (SEQ ID NO: 2552) |
| I090E05 | 546 | 141 - 249 | 163 - 173 | 189 - 195 | 228 - 238 | 1 - 123 | 26 - 35 | 50 - 66 | 99 - 112 | SRDLLLFPSAPISF (SEQ ID NO: 2588) |
| I090E06 | 547 | 141 - 249 | 163 - 173 | 189 - 195 | 228 - 238 | 1 - 123 | 26 - 35 | 50 - 66 | 99 - 112 | SRDLLLFPQGPLSF (SEQ ID NO: 2443) |
| I090E07 | 548 | 141 - 249 | 163 - 173 | 189 - 195 | 228 - 238 | 1 - 123 | 26 - 35 | 50 - 66 | 99 - 112 | SRDLLLFPGSPLHP (SEQ ID NO: 2484) |
| I090E09 | 549 | 141 - 249 | 163 - 173 | 189 - 195 | 228 - 238 | 1 - 123 | 26 - 35 | 50 - 66 | 99 - 112 | SRDLLLFPSDPLSF (SEQ ID NO: 2647) |
| I090E11 | 550 | 141 - 249 | 163 - 173 | 189 - 195 | 228 - 238 | 1 - 123 | 26 - 35 | 50 - 66 | 99 - 112 | SRDLLLFPHDGLAP (SEQ ID NO: 2700) |
| I090E12 | 551 | 141 - 249 | 163 - 173 | 189 - 195 | 228 - 238 | 1 - 123 | 26 - 35 | 50 - 66 | 99 - 112 | SRDLLLFPTSPLTF (SEQ ID NO: 2582) |
| I090F01 | 552 | 141 - 249 | 163 - 173 | 189 - 195 | 228 - 238 | 1 - 123 | 26 - 35 | 50 - 66 | 99 - 112 | SRDLLLFPNGPLHP (SEQ ID NO: 2649) |
| I090F02 | 553 | 141 - 249 | 163 - 173 | 189 - 195 | 228 - 238 | 1 - 123 | 26 - 35 | 50 - 66 | 99 - 112 | SRDLLLFPQAPLSF (SEQ ID NO: 2696) |
| I090F03 | 554 | 141 - 249 | 163 - 173 | 189 - 195 | 228 - 238 | 1 - 123 | 26 - 35 | 50 - 66 | 99 - 112 | SRDLLLFPTAPLSF (SEQ ID NO: 2526) |
| I090F04 | 555 | 141 - 249 | 163 - 173 | 189 - 195 | 228 - 238 | 1 - 123 | 26 - 35 | 50 - 66 | 99 - 112 | SRDLLLFPFFPLQF (SEQ ID NO: 2460) |
| I090F05 | 556 | 141 - 249 | 163 - 173 | 189 - 195 | 228 - 238 | 1 - 123 | 26 - 35 | 50 - 66 | 99 - 112 | SRDLLLFPLDPLHF (SEQ ID NO: 2359) |
| I090F06 | 557 | 141 - 249 | 163 - 173 | 189 - 195 | 228 - 238 | 1 - 123 | 26 - 35 | 50 - 66 | 99 - 112 | SRDLLLFPSEPLQL (SEQ ID NO: 2666) |
| I090F07 | 558 | 141 - 249 | 163 - 173 | 189 - 195 | 228 - 238 | 1 - 123 | 26 - 35 | 50 - 66 | 99 - 112 | SRDLLLFPFAPLRF (SEQ ID NO: 2451) |
| I090F08 | 559 | 141 - 249 | 163 - 173 | 189 - 195 | 228 - 238 | 1 - 123 | 26 - 35 | 50 - 66 | 99 - 112 | SRDLLLFPLHPLIF (SEQ ID NO: 2570) |
| I090F09 | 560 | 141 - 249 | 163 - 173 | 189 - 195 | 228 - 238 | 1 - 123 | 26 - 35 | 50 - 66 | 99 - 112 | SRDLLLFPHYPLLF (SEQ ID NO: 2344) |
| I090F10 | 561 | 141 - 249 | 163 - 173 | 189 - 195 | 228 - 238 | 1 - 123 | 26 - 35 | 50 - 66 | 99 - 112 | SRDLLLFPRDPLRI (SEQ ID NO: 2527) |
| I090F11 | 562 | 141 - 249 | 163 - 173 | 189 - 195 | 228 - 238 | 1 - 123 | 26 - 35 | 50 - 66 | 99 - 112 | SRDLLLFPSNPLTF (SEQ ID NO: 2698) |
| I090G01 | 563 | 141 - 249 | 163 - 173 | 189 - 195 | 228 - 238 | 1 - 123 | 26 - 35 | 50 - 66 | 99 - 112 | SRDLLLFPTAPLEI (SEQ ID NO: 2347) |
| I090G02 | 564 | 141 - 249 | 163 - 173 | 189 - 195 | 228 - 238 | 1 - 123 | 26 - 35 | 50 - 66 | 99 - 112 | SRDLLLFPRDPLQF (SEQ ID NO: 2395) |
| I090G04 | 565 | 141 - 249 | 163 - 173 | 189 - 195 | 228 - 238 | 1 - 123 | 26 - 35 | 50 - 66 | 99 - 112 | SRDLLLFPHEPLAF (SEQ ID NO: 2633) |
| I090G05 | 566 | 141 - 249 | 163 - 173 | 189 - 195 | 228 - 238 | 1 - 123 | 26 - 35 | 50 - 66 | 99 - 112 | SRDLLLFPRAPLAP (SEQ ID NO: 2472) |
| I090G06 | 567 | 141 - 249 | 163 - 173 | 189 - 195 | 228 - 238 | 1 - 123 | 26 - 35 | 50 - 66 | 99 - 112 | SRDLLLFPYSPLAF (SEQ ID NO: 2656) |
| I090G07 | 568 | 141 - 249 | 163 - 173 | 189 - 195 | 228 - 238 | 1 - 123 | 26 - 35 | 50 - 66 | 99 - 112 | SRDLLLFPHTPLDS (SEQ ID NO: 2480) |
| I090G08 | 569 | 141 - 249 | 163 - 173 | 189 - 195 | 228 - 238 | 1 - 123 | 26 - 35 | 50 - 66 | 99 - 112 | SRDLLLFPHTPLTF (SEQ ID NO: 2492) |
| I090G09 | 570 | 141 - 249 | 163 - 173 | 189 - 195 | 228 - 238 | 1 - 123 | 26 - 35 | 50 - 66 | 99 - 112 | SRDLLLFPSEPLRI (SEQ ID NO: 2356) |
| I090G10 | 571 | 141 - 249 | 163 - 173 | 189 - 195 | 228 - 238 | 1 - 123 | 26 - 35 | 50 - 66 | 99 - 112 | SRDLLLFPTAPLDF (SEQ ID NO: 2343) |
| I090G12 | 572 | 141 - 249 | 163 - 173 | 189 - 195 | 228 - 238 | 1 - 123 | 26 - 35 | 50 - 66 | 99 - 112 | SRDLLLFPNRGLDL (SEQ ID NO: 2669) |
| I091A02 | 573 | 141 - 249 | 163 - 173 | 189 - 195 | 228 - 238 | 1 - 123 | 26 - 35 | 50 - 66 | 99 - 112 | SRDLLLFPYDPLFM (SEQ ID NO: 2724) |
| I091A03 | 574 | 141 - 249 | 163 - 173 | 189 - 195 | 228 - 238 | 1 - 123 | 26 - 35 | 50 - 66 | 99 - 112 | SRDLLLFPHAPLYP (SEQ ID NO: 2592) |
| I091A06 | 575 | 141 - 249 | 163 - 173 | 189 - 195 | 228 - 238 | 1 - 123 | 26 - 35 | 50 - 66 | 99 - 112 | SRDLLLFPSAPLAF (SEQ ID NO: 2594) |
| I091A11 | 576 | 141 - 249 | 163 - 173 | 189 - 195 | 228 - 238 | 1 - 123 | 26 - 35 | 50 - 66 | 99 - 112 | SRDLLLFPHSPITF (SEQ ID NO: 2441) |
| I091B01 | 577 | 141 - 249 | 163 - 173 | 189 - 195 | 228 - 238 | 1 - 123 | 26 - 35 | 50 - 66 | 99 - 112 | SRDLLLFPRYPLFF (SEQ ID NO: 2585) |
| I091B02 | 578 | 141 - 249 | 163 - 173 | 189 - 195 | 228 - 238 | 1 - 123 | 26 - 35 | 50 - 66 | 99 - 112 | SRDLLLFPYAPLDF (SEQ ID NO: 2361) |
| I091B04 | 579 | 141 - 249 | 163 - 173 | 189 - 195 | 228 - 238 | 1 - 123 | 26 - 35 | 50 - 66 | 99 - 112 | SRDLLLFPRDPLQF (SEQ ID NO: 2395) |
| I091B05 | 580 | 141 - 249 | 163 - 173 | 189 - 195 | 228 - 238 | 1 - 123 | 26 - 35 | 50 - 66 | 99 - 112 | SRDLLLFPHAPLEL (SEQ ID NO: 2475) |
| I091B07 | 581 | 141 - 249 | 163 - 173 | 189 - 195 | 228 - 238 | 1 - 123 | 26 - 35 | 50 - 66 | 99 - 112 | SRDLLLFPSAPLTF (SEQ ID NO: 2626) |

| | | | | | | | | | | | |
|---|---|---|---|---|---|---|---|---|---|---|---|
| I091B10 | 582 | 141 - 249 | 163 - 173 | 189 - 195 | 228 - 238 | 1 - 123 | 26 - 35 | 50 - 66 | 99 - 112 | SRDLLLFPTAPLAF (SEQ ID NO: 2342) |
| I091B11 | 583 | 141 - 249 | 163 - 173 | 189 - 195 | 228 - 238 | 1 - 123 | 26 - 35 | 50 - 66 | 99 - 112 | SRDLLLFPHSPLDF (SEQ ID NO: 2444) |
| I091B12 | 584 | 141 - 249 | 163 - 173 | 189 - 195 | 228 - 238 | 1 - 123 | 26 - 35 | 50 - 66 | 99 - 112 | SRDLLLFPSHPLTF (SEQ ID NO: 2690) |
| I091C02 | 585 | 141 - 249 | 163 - 173 | 189 - 195 | 228 - 238 | 1 - 123 | 26 - 35 | 50 - 66 | 99 - 112 | SRDLLLFPAHPLVI (SEQ ID NO: 2414) |
| I091C03 | 586 | 141 - 249 | 163 - 173 | 189 - 195 | 228 - 238 | 1 - 123 | 26 - 35 | 50 - 66 | 99 - 112 | SRDLLLFPQAPLYP (SEQ ID NO: 2378) |
| I091C04 | 587 | 141 - 249 | 163 - 173 | 189 - 195 | 228 - 238 | 1 - 123 | 26 - 35 | 50 - 66 | 99 - 112 | SRDLLLFPTAPLTF (SEQ ID NO: 2531) |
| I091C05 | 588 | 141 - 249 | 163 - 173 | 189 - 195 | 228 - 238 | 1 - 123 | 26 - 35 | 50 - 66 | 99 - 112 | SRDLLLFPTTPLHF (SEQ ID NO: 2583) |
| I091C06 | 589 | 141 - 249 | 163 - 173 | 189 - 195 | 228 - 238 | 1 - 123 | 26 - 35 | 50 - 66 | 99 - 112 | SRDLLLFPHYPLLF (SEQ ID NO: 2344) |
| I091C09 | 590 | 141 - 249 | 163 - 173 | 189 - 195 | 228 - 238 | 1 - 123 | 26 - 35 | 50 - 66 | 99 - 112 | SRDLLLFPHHPLSF (SEQ ID NO: 2415) |
| I091C11 | 591 | 141 - 249 | 163 - 173 | 189 - 195 | 228 - 238 | 1 - 123 | 26 - 35 | 50 - 66 | 99 - 112 | SRDLLLFPYHSYDI (SEQ ID NO: 2650) |
| I091C12 | 592 | 141 - 249 | 163 - 173 | 189 - 195 | 228 - 238 | 1 - 123 | 26 - 35 | 50 - 66 | 99 - 112 | SRDLLLFPYATLSF (SEQ ID NO: 2618) |
| I091D01 | 593 | 141 - 249 | 163 - 173 | 189 - 195 | 228 - 238 | 1 - 123 | 26 - 35 | 50 - 66 | 99 - 112 | SRDLLLFPNSPLAP (SEQ ID NO: 2672) |
| I091D02 | 594 | 141 - 249 | 163 - 173 | 189 - 195 | 228 - 238 | 1 - 123 | 26 - 35 | 50 - 66 | 99 - 112 | SRDLLLFPYSPLQP (SEQ ID NO: 2673) |
| I091D04 | 595 | 141 - 249 | 163 - 173 | 189 - 195 | 228 - 238 | 1 - 123 | 26 - 35 | 50 - 66 | 99 - 112 | SRDLLLFPQGPLSF (SEQ ID NO: 2443) |
| I091D05 | 596 | 141 - 249 | 163 - 173 | 189 - 195 | 228 - 238 | 1 - 123 | 26 - 35 | 50 - 66 | 99 - 112 | SRDLLLFPHDPLAP (SEQ ID NO: 2606) |
| I091D06 | 597 | 140 - 248 | 162 - 172 | 188 - 194 | 227 - 237 | 1 - 122 | 26 - 35 | 50 - 66 | 99 - 111 | SRDLLLFPHSPLL (SEQ ID NO: 2456) |
| I091D07 | 598 | 141 - 249 | 163 - 173 | 189 - 195 | 228 - 238 | 1 - 123 | 26 - 35 | 50 - 66 | 99 - 112 | SRDLLLFPNGALRF (SEQ ID NO: 2645) |
| I091D09 | 599 | 141 - 249 | 163 - 173 | 189 - 195 | 228 - 238 | 1 - 123 | 26 - 35 | 50 - 66 | 99 - 112 | SRDLLLFPYSPLRF (SEQ ID NO: 2719) |
| I091E01 | 600 | 141 - 249 | 163 - 173 | 189 - 195 | 228 - 238 | 1 - 123 | 26 - 35 | 50 - 66 | 99 - 112 | SRDLLLFPDAPLHP (SEQ ID NO: 2425) |
| I091E02 | 601 | 141 - 249 | 163 - 173 | 189 - 195 | 228 - 238 | 1 - 123 | 26 - 35 | 50 - 66 | 99 - 112 | SRDLLLFPQAPLFP (SEQ ID NO: 2689) |
| I091E03 | 602 | 141 - 249 | 163 - 173 | 189 - 195 | 228 - 238 | 1 - 123 | 26 - 35 | 50 - 66 | 99 - 112 | SRDLLLFPSAPLWP (SEQ ID NO: 2352) |
| I091E04 | 603 | 141 - 249 | 163 - 173 | 189 - 195 | 228 - 238 | 1 - 123 | 26 - 35 | 50 - 66 | 99 - 112 | SRDLLLFPKSPLAF (SEQ ID NO: 2547) |
| I091E06 | 604 | 141 - 249 | 163 - 173 | 189 - 195 | 228 - 238 | 1 - 123 | 26 - 35 | 50 - 66 | 99 - 112 | SRDLLLFPSSPLHP (SEQ ID NO: 2576) |
| I091E07 | 605 | 141 - 249 | 163 - 173 | 189 - 195 | 228 - 238 | 1 - 123 | 26 - 35 | 50 - 66 | 99 - 112 | SRDLLLFPNHPLTF (SEQ ID NO: 2661) |
| I091E08 | 606 | 141 - 249 | 163 - 173 | 189 - 195 | 228 - 238 | 1 - 123 | 26 - 35 | 50 - 66 | 99 - 112 | SRDLLLFPNAPLDS (SEQ ID NO: 2607) |
| I091E09 | 607 | 141 - 249 | 163 - 173 | 189 - 195 | 228 - 238 | 1 - 123 | 26 - 35 | 50 - 66 | 99 - 112 | SRDLLLFPYAPLDF (SEQ ID NO: 2361) |
| I091E10 | 608 | 141 - 249 | 163 - 173 | 189 - 195 | 228 - 238 | 1 - 123 | 26 - 35 | 50 - 66 | 99 - 112 | SRDLLLFPSSPLEF (SEQ ID NO: 2711) |
| I091F01 | 609 | 141 - 249 | 163 - 173 | 189 - 195 | 228 - 238 | 1 - 123 | 26 - 35 | 50 - 66 | 99 - 112 | SRDLLLFPRAPLFF (SEQ ID NO: 2486) |
| I091F03 | 610 | 141 - 249 | 163 - 173 | 189 - 195 | 228 - 238 | 1 - 123 | 26 - 35 | 50 - 66 | 99 - 112 | SRDLLLFPMAPLVG (SEQ ID NO: 2599) |
| I091F05 | 611 | 141 - 249 | 163 - 173 | 189 - 195 | 228 - 238 | 1 - 123 | 26 - 35 | 50 - 66 | 99 - 112 | SRDLLLFPLAPLHP (SEQ ID NO: 2553) |
| I091F06 | 612 | 141 - 249 | 163 - 173 | 189 - 195 | 228 - 238 | 1 - 123 | 26 - 35 | 50 - 66 | 99 - 112 | SRDLLLFPHDPLGF (SEQ ID NO: 2353) |
| I091F07 | 613 | 141 - 249 | 163 - 173 | 189 - 195 | 228 - 238 | 1 - 123 | 26 - 35 | 50 - 66 | 99 - 112 | SRDLLLFPHYGMDV (SEQ ID NO: 2133) |
| I091F08 | 614 | 141 - 249 | 163 - 173 | 189 - 195 | 228 - 238 | 1 - 123 | 26 - 35 | 50 - 66 | 99 - 112 | SRDLLLFPQSPLLF (SEQ ID NO: 2458) |
| I091F09 | 615 | 141 - 249 | 163 - 173 | 189 - 195 | 228 - 238 | 1 - 123 | 26 - 35 | 50 - 66 | 99 - 112 | SRDLLLFPHEHLSF (SEQ ID NO: 2354) |
| I091F10 | 616 | 141 - 249 | 163 - 173 | 189 - 195 | 228 - 238 | 1 - 123 | 26 - 35 | 50 - 66 | 99 - 112 | SRDLLLFPHSPLDF (SEQ ID NO: 2444) |
| I091F11 | 617 | 141 - 249 | 163 - 173 | 189 - 195 | 228 - 238 | 1 - 123 | 26 - 35 | 50 - 66 | 99 - 112 | SRDLLLFPHSPLSP (SEQ ID NO: 2549) |
| I091F12 | 618 | 141 - 249 | 163 - 173 | 189 - 195 | 228 - 238 | 1 - 123 | 26 - 35 | 50 - 66 | 99 - 112 | SRDLLLFPHYGMDV (SEQ ID NO: 2133) |
| I091G01 | 619 | 141 - 249 | 163 - 173 | 189 - 195 | 228 - 238 | 1 - 123 | 26 - 35 | 50 - 66 | 99 - 112 | SRDLLLFPNAALYP (SEQ ID NO: 2386) |
| I091G03 | 620 | 141 - 249 | 163 - 173 | 189 - 195 | 228 - 238 | 1 - 123 | 26 - 35 | 50 - 66 | 99 - 112 | SRDLLLFPNDPLFG (SEQ ID NO: 2355) |
| I091G04 | 621 | 141 - 249 | 163 - 173 | 189 - 195 | 228 - 238 | 1 - 123 | 26 - 35 | 50 - 66 | 99 - 112 | SRDLLLFPGAPLSP (SEQ ID NO: 2478) |
| I091G05 | 622 | 141 - 249 | 163 - 173 | 189 - 195 | 228 - 238 | 1 - 123 | 26 - 35 | 50 - 66 | 99 - 112 | ARDLLLFPAAPLWP (SEQ ID NO: 2397) |
| I091G06 | 623 | 140 - 248 | 162 - 172 | 188 - 194 | 227 - 237 | 1 - 122 | 26 - 35 | 50 - 66 | 99 - 111 | SRDLLLFPNDPLR (SEQ ID NO: 2637) |

| | | | | | | | | | | |
|---|---|---|---|---|---|---|---|---|---|---|
| I091G07 | 624 | 141 - 249 | 163 - 173 | 189 - 195 | 228 - 238 | 1 - 123 | 26 - 35 | 50 - 66 | 99 - 112 | SRDLLLFPTAPLDP (SEQ ID NO: 2345) |
| I091G09 | 625 | 141 - 249 | 163 - 173 | 189 - 195 | 228 - 238 | 1 - 123 | 26 - 35 | 50 - 66 | 99 - 112 | SRDLLLFPTAPLFP (SEQ ID NO: 2349) |
| I091G10 | 626 | 141 - 249 | 163 - 173 | 189 - 195 | 228 - 238 | 1 - 123 | 26 - 35 | 50 - 66 | 99 - 112 | SRDLLLFPSDPLVF (SEQ ID NO: 2660) |
| I091G11 | 627 | 141 - 249 | 163 - 173 | 189 - 195 | 228 - 238 | 1 - 123 | 26 - 35 | 50 - 66 | 99 - 112 | SRDLLLFPGSPLTF (SEQ ID NO: 2389) |
| I091G12 | 628 | 141 - 249 | 163 - 173 | 189 - 195 | 228 - 238 | 1 - 123 | 26 - 35 | 50 - 66 | 99 - 112 | SRDLLLFPYSHLEF (SEQ ID NO: 2655) |
| I104A01 | 629 | 141 - 249 | 163 - 173 | 189 - 195 | 228 - 238 | 1 - 123 | 26 - 35 | 50 - 66 | 99 - 112 | SRDLLLFPQSPLHP (SEQ ID NO: 2455) |
| I104A07 | 630 | 141 - 249 | 163 - 173 | 189 - 195 | 228 - 238 | 1 - 123 | 26 - 35 | 50 - 66 | 99 - 112 | SRDLLLFPQAPLFP (SEQ ID NO: 2689) |
| I104A08 | 631 | 141 - 249 | 163 - 173 | 189 - 195 | 228 - 238 | 1 - 123 | 26 - 35 | 50 - 66 | 99 - 112 | SRDLLLFPYAPLTF (SEQ ID NO: 2617) |
| I104A09 | 632 | 141 - 249 | 163 - 173 | 189 - 195 | 228 - 238 | 1 - 123 | 26 - 35 | 50 - 66 | 99 - 112 | SRDLLLFPQNPLHP (SEQ ID NO: 2506) |
| I104A10 | 633 | 141 - 249 | 163 - 173 | 189 - 195 | 228 - 238 | 1 - 123 | 26 - 35 | 50 - 66 | 99 - 112 | SRDLLLFPHEPLCF (SEQ ID NO: 2636) |
| I104A11 | 634 | 141 - 249 | 163 - 173 | 189 - 195 | 228 - 238 | 1 - 123 | 26 - 35 | 50 - 66 | 99 - 112 | SRDLLLFPSAPLSF (SEQ ID NO: 2611) |
| I104A12 | 635 | 141 - 249 | 163 - 173 | 189 - 195 | 228 - 238 | 1 - 123 | 26 - 35 | 50 - 66 | 99 - 112 | SRDLLLFPMAPLRF (SEQ ID NO: 2593) |
| I104B02 | 636 | 141 - 249 | 163 - 173 | 189 - 195 | 228 - 238 | 1 - 123 | 26 - 35 | 50 - 66 | 99 - 112 | SRDLLLFPRSPLSF (SEQ ID NO: 2557) |
| I104B04 | 637 | 141 - 249 | 163 - 173 | 189 - 195 | 228 - 238 | 1 - 123 | 26 - 35 | 50 - 66 | 99 - 112 | SRDLLLFPSAPLYP (SEQ ID NO: 2387) |
| I104B09 | 638 | 141 - 249 | 163 - 173 | 189 - 195 | 228 - 238 | 1 - 123 | 26 - 35 | 50 - 66 | 99 - 112 | SRDLLLFPRDPLQF (SEQ ID NO: 2395) |
| I104B11 | 639 | 141 - 249 | 163 - 173 | 189 - 195 | 228 - 238 | 1 - 123 | 26 - 35 | 50 - 66 | 99 - 112 | SRDLLLFPTAPLTF (SEQ ID NO: 2531) |
| I104C01 | 640 | 141 - 249 | 163 - 173 | 189 - 195 | 228 - 238 | 1 - 123 | 26 - 35 | 50 - 66 | 99 - 112 | SRDLLLFPYSPLYP (SEQ ID NO: 2710) |
| I104C04 | 641 | 141 - 249 | 163 - 173 | 189 - 195 | 228 - 238 | 1 - 123 | 26 - 35 | 50 - 66 | 99 - 112 | SRDLLLFPASPLIF (SEQ ID NO: 2417) |
| I104C05 | 642 | 141 - 249 | 163 - 173 | 189 - 195 | 228 - 238 | 1 - 123 | 26 - 35 | 50 - 66 | 99 - 112 | SRDLLLFPRHPLLF (SEQ ID NO: 2543) |
| I104C06 | 643 | 140 - 248 | 162 - 172 | 188 - 194 | 227 - 237 | 1 - 122 | 26 - 35 | 50 - 66 | 99 - 111 | SRDLLLFPHAPLE (SEQ ID NO: 2524) |
| I104C07 | 644 | 141 - 249 | 163 - 173 | 189 - 195 | 228 - 238 | 1 - 123 | 26 - 35 | 50 - 66 | 99 - 112 | SRDLLLFPHAPLHP (SEQ ID NO: 2370) |
| I104C09 | 645 | 141 - 249 | 163 - 173 | 189 - 195 | 228 - 238 | 1 - 123 | 26 - 35 | 50 - 66 | 99 - 112 | SRDLLLFPHFPLIF (SEQ ID NO: 2399) |
| I104C11 | 646 | 141 - 249 | 163 - 173 | 189 - 195 | 228 - 238 | 1 - 123 | 26 - 35 | 50 - 66 | 99 - 112 | SRDLLLFPHEPLIF (SEQ ID NO: 2644) |
| I104D01 | 647 | 141 - 249 | 163 - 173 | 189 - 195 | 228 - 238 | 1 - 123 | 26 - 35 | 50 - 66 | 99 - 112 | SRDLLLFPNHAFDL (SEQ ID NO: 2652) |
| I104D02 | 648 | 141 - 249 | 163 - 173 | 189 - 195 | 228 - 238 | 1 - 123 | 26 - 35 | 50 - 66 | 99 - 112 | SRDLLLFPHTILYP (SEQ ID NO: 2497) |
| I104D03 | 649 | 141 - 249 | 163 - 173 | 189 - 195 | 228 - 238 | 1 - 123 | 26 - 35 | 50 - 66 | 99 - 112 | SRDLLLFPDWPLYP (SEQ ID NO: 2483) |
| I104D04 | 650 | 141 - 249 | 163 - 173 | 189 - 195 | 228 - 238 | 1 - 123 | 26 - 35 | 50 - 66 | 99 - 112 | SRDLLLFPHYPLFL (SEQ ID NO: 2511) |
| I104D07 | 651 | 141 - 249 | 163 - 173 | 189 - 195 | 228 - 238 | 1 - 123 | 26 - 35 | 50 - 66 | 99 - 112 | SRDLLLFPQAPLHP (SEQ ID NO: 2691) |
| I104D08 | 652 | 141 - 249 | 163 - 173 | 189 - 195 | 228 - 238 | 1 - 123 | 26 - 35 | 50 - 66 | 99 - 112 | SRDLLLFPHAPMDP (SEQ ID NO: 2595) |
| I104D09 | 653 | 141 - 249 | 163 - 173 | 189 - 195 | 228 - 238 | 1 - 123 | 26 - 35 | 50 - 66 | 99 - 112 | SRDLLLFPRAPLTF (SEQ ID NO: 2500) |
| I104E01 | 654 | 141 - 249 | 163 - 173 | 189 - 195 | 228 - 238 | 1 - 123 | 26 - 35 | 50 - 66 | 99 - 112 | SRDLLLFPRATLEF (SEQ ID NO: 2502) |
| I104E02 | 655 | 141 - 249 | 163 - 173 | 189 - 195 | 228 - 238 | 1 - 123 | 26 - 35 | 50 - 66 | 99 - 112 | SRDLLLFPHSPLFP (SEQ ID NO: 2447) |
| I104E03 | 656 | 141 - 249 | 163 - 173 | 189 - 195 | 228 - 238 | 1 - 123 | 26 - 35 | 50 - 66 | 99 - 112 | SRDLLLFPNDPLVL (SEQ ID NO: 2641) |
| I104E05 | 657 | 141 - 249 | 163 - 173 | 189 - 195 | 228 - 238 | 1 - 123 | 26 - 35 | 50 - 66 | 99 - 112 | SRDLLLFPHDPLYI (SEQ ID NO: 2463) |
| I104E11 | 658 | 141 - 249 | 163 - 173 | 189 - 195 | 228 - 238 | 1 - 123 | 26 - 35 | 50 - 66 | 99 - 112 | SRDLLLFPYAPLSF (SEQ ID NO: 2385) |
| I104E12 | 659 | 141 - 249 | 163 - 173 | 189 - 195 | 228 - 238 | 1 - 123 | 26 - 35 | 50 - 66 | 99 - 112 | SRDLLLFPASPLNP (SEQ ID NO: 2364) |
| I104F02 | 660 | 141 - 249 | 163 - 173 | 189 - 195 | 228 - 238 | 1 - 123 | 26 - 35 | 50 - 66 | 99 - 112 | SRDLLLFPHDPLSP (SEQ ID NO: 2616) |
| I104F03 | 661 | 141 - 249 | 163 - 173 | 189 - 195 | 228 - 238 | 1 - 123 | 26 - 35 | 50 - 66 | 99 - 112 | SRDLLLFPRDPLRF (SEQ ID NO: 2360) |
| I104F04 | 662 | 141 - 249 | 163 - 173 | 189 - 195 | 228 - 238 | 1 - 123 | 26 - 35 | 50 - 66 | 99 - 112 | SRDLLLFPGDPLDF (SEQ ID NO: 2481) |
| I104F05 | 663 | 141 - 249 | 163 - 173 | 189 - 195 | 228 - 238 | 1 - 123 | 26 - 35 | 50 - 66 | 99 - 112 | SRDLLLFPHGPLTF (SEQ ID NO: 2402) |
| I104F06 | 664 | 141 - 249 | 163 - 173 | 189 - 195 | 228 - 238 | 1 - 123 | 26 - 35 | 50 - 66 | 99 - 112 | SRDLLLFPHAPLSP (SEQ ID NO: 2573) |
| I104F07 | 665 | 141 - 249 | 163 - 173 | 189 - 195 | 228 - 238 | 1 - 123 | 26 - 35 | 50 - 66 | 99 - 112 | SRDLLLFPSSPLIL (SEQ ID NO: 2465) |

| | | | | | | | | | | |
|---|---|---|---|---|---|---|---|---|---|---|
| I104F10 | 666 | 141 - 249 | 163 - 173 | 189 - 195 | 228 - 238 | 1 - 123 | 26 - 35 | 50 - 66 | 99 - 112 | SRDLLLFPNSPLSP (SEQ ID NO: 2362) |
| I104F11 | 667 | 141 - 249 | 163 - 173 | 189 - 195 | 228 - 238 | 1 - 123 | 26 - 35 | 50 - 66 | 99 - 112 | SRDLLLFPQDPLVF (SEQ ID NO: 2708) |
| I104F12 | 668 | 141 - 249 | 163 - 173 | 189 - 195 | 228 - 238 | 1 - 123 | 26 - 35 | 50 - 66 | 99 - 112 | SRDLLLFPKAPLVF (SEQ ID NO: 2544) |
| I104G04 | 669 | 141 - 249 | 163 - 173 | 189 - 195 | 228 - 238 | 1 - 123 | 26 - 35 | 50 - 66 | 99 - 112 | SRDLLLFPHAPLRF (SEQ ID NO: 2559) |
| I104G05 | 670 | 141 - 249 | 163 - 173 | 189 - 195 | 228 - 238 | 1 - 123 | 26 - 35 | 50 - 66 | 99 - 112 | SRDLLLFPRAPLAP (SEQ ID NO: 2476) |
| I104G09 | 671 | 141 - 249 | 163 - 173 | 189 - 195 | 228 - 238 | 1 - 123 | 26 - 35 | 50 - 66 | 99 - 112 | SRDLLLFPTAPLNF (SEQ ID NO: 2518) |
| I104G11 | 672 | 141 - 249 | 163 - 173 | 189 - 195 | 228 - 238 | 1 - 123 | 26 - 35 | 50 - 66 | 99 - 112 | SRHLLLFPQGPLSF (SEQ ID NO: 2482) |
| I105A02 | 673 | 141 - 249 | 163 - 173 | 189 - 195 | 228 - 238 | 1 - 123 | 26 - 35 | 50 - 66 | 99 - 112 | SRDLLLFPHLPLNP (SEQ ID NO: 2494) |
| I105A03 | 674 | 141 - 249 | 163 - 173 | 189 - 195 | 228 - 238 | 1 - 123 | 26 - 35 | 50 - 66 | 99 - 112 | SRDLLLFPHHSFDL (SEQ ID NO: 2147) |
| I105A04 | 675 | 141 - 249 | 163 - 173 | 189 - 195 | 228 - 238 | 1 - 123 | 26 - 35 | 50 - 66 | 99 - 112 | SRDLLLFPGAPLAP (SEQ ID NO: 2487) |
| I105A08 | 676 | 141 - 249 | 163 - 173 | 189 - 195 | 228 - 238 | 1 - 123 | 26 - 35 | 50 - 66 | 99 - 112 | SRDLLLFPQAPLYP (SEQ ID NO: 2378) |
| I105A09 | 677 | 141 - 249 | 163 - 173 | 189 - 195 | 228 - 238 | 1 - 123 | 26 - 35 | 50 - 66 | 99 - 112 | SRDLLLFPRSPLSF (SEQ ID NO: 2557) |
| I105A11 | 678 | 141 - 249 | 163 - 173 | 189 - 195 | 228 - 238 | 1 - 123 | 26 - 35 | 50 - 66 | 99 - 112 | SRDLLLFPSHSFDI (SEQ ID NO: 2692) |
| I105B04 | 679 | 141 - 249 | 163 - 173 | 189 - 195 | 228 - 238 | 1 - 123 | 26 - 35 | 50 - 66 | 99 - 112 | SRDLLLFPYSPLHP (SEQ ID NO: 2658) |
| I105B05 | 680 | 141 - 249 | 163 - 173 | 189 - 195 | 228 - 238 | 1 - 123 | 26 - 35 | 50 - 66 | 99 - 112 | SRDLLLFPYSPLSF (SEQ ID NO: 2676) |
| I105B07 | 681 | 141 - 249 | 163 - 173 | 189 - 195 | 228 - 238 | 1 - 123 | 26 - 35 | 50 - 66 | 99 - 112 | SRDLLLFPHHSFDL (SEQ ID NO: 2147) |
| I105B08 | 682 | 141 - 249 | 163 - 173 | 189 - 195 | 228 - 238 | 1 - 123 | 26 - 35 | 50 - 66 | 99 - 112 | SRDLLLFPHHSFDL (SEQ ID NO: 2147) |
| I105B10 | 683 | 141 - 249 | 163 - 173 | 189 - 195 | 228 - 238 | 1 - 123 | 26 - 35 | 50 - 66 | 99 - 112 | SRDLLLFPASPLNP (SEQ ID NO: 2364) |
| I105B11 | 684 | 141 - 249 | 163 - 173 | 189 - 195 | 228 - 238 | 1 - 123 | 26 - 35 | 50 - 66 | 99 - 112 | SRDLLLFPHEPLSP (SEQ ID NO: 2651) |
| I105B12 | 685 | 141 - 249 | 163 - 173 | 189 - 195 | 228 - 238 | 1 - 123 | 26 - 35 | 50 - 66 | 99 - 112 | SRDLLLFPLDPLII (SEQ ID NO: 2560) |
| I105C02 | 686 | 141 - 249 | 163 - 173 | 189 - 195 | 228 - 238 | 1 - 123 | 26 - 35 | 50 - 66 | 99 - 112 | SRDLLLFPRAPLAF (SEQ ID NO: 2472) |
| I105C03 | 687 | 141 - 249 | 163 - 173 | 189 - 195 | 228 - 238 | 1 - 123 | 26 - 35 | 50 - 66 | 99 - 112 | SRDLLLFPSSPLSF (SEQ ID NO: 2715) |
| I105C05 | 688 | 141 - 249 | 163 - 173 | 189 - 195 | 228 - 238 | 1 - 123 | 26 - 35 | 50 - 66 | 99 - 112 | SRDLLLFPHYGMDV (SEQ ID NO: 2133) |
| I105C06 | 689 | 141 - 249 | 163 - 173 | 189 - 195 | 228 - 238 | 1 - 123 | 26 - 35 | 50 - 66 | 99 - 112 | SRDLLLFPRAPLDF (SEQ ID NO: 2367) |
| I105C08 | 690 | 141 - 249 | 163 - 173 | 189 - 195 | 228 - 238 | 1 - 123 | 26 - 35 | 50 - 66 | 99 - 112 | SRDLLLFPRSPLTF (SEQ ID NO: 2562) |
| I105C12 | 691 | 141 - 249 | 163 - 173 | 189 - 195 | 228 - 238 | 1 - 123 | 26 - 35 | 50 - 66 | 99 - 112 | SRDLLLFPQHGFDA (SEQ ID NO: 2446) |
| I105D04 | 692 | 141 - 249 | 163 - 173 | 189 - 195 | 228 - 238 | 1 - 123 | 26 - 35 | 50 - 66 | 99 - 112 | SRDLLLFPRDPLRF (SEQ ID NO: 2360) |
| I105D06 | 693 | 141 - 249 | 163 - 173 | 189 - 195 | 228 - 238 | 1 - 123 | 26 - 35 | 50 - 66 | 99 - 112 | SRDLLLFPRDPLSF (SEQ ID NO: 2368) |
| I105D08 | 694 | 141 - 249 | 163 - 173 | 189 - 195 | 228 - 238 | 1 - 123 | 26 - 35 | 50 - 66 | 99 - 112 | SRDLLLFPYAPLAF (SEQ ID NO: 2608) |
| I105D09 | 695 | 141 - 249 | 163 - 173 | 189 - 195 | 228 - 238 | 1 - 123 | 26 - 35 | 50 - 66 | 99 - 112 | SRDLLLFPHAAFDV (SEQ ID NO: 2619) |
| I105D10 | 696 | 141 - 249 | 163 - 173 | 189 - 195 | 228 - 238 | 1 - 123 | 26 - 35 | 50 - 66 | 99 - 112 | SRDLLLFPHEPLFP (SEQ ID NO: 2640) |
| I105D11 | 697 | 141 - 249 | 163 - 173 | 189 - 195 | 228 - 238 | 1 - 123 | 26 - 35 | 50 - 66 | 99 - 112 | SRDLLLFPRSALTF (SEQ ID NO: 2519) |
| I105E01 | 698 | 141 - 249 | 163 - 173 | 189 - 195 | 228 - 238 | 1 - 123 | 26 - 35 | 50 - 66 | 99 - 112 | SRDLLLFPHHSFDS (SEQ ID NO: 2422) |
| I105E06 | 699 | 141 - 249 | 163 - 173 | 189 - 195 | 228 - 238 | 1 - 123 | 26 - 35 | 50 - 66 | 99 - 112 | SRDLLLFPHYGMDV (SEQ ID NO: 2133) |
| I105E11 | 700 | 141 - 249 | 163 - 173 | 189 - 195 | 228 - 238 | 1 - 123 | 26 - 35 | 50 - 66 | 99 - 112 | SRDLLLFPNSPLHP (SEQ ID NO: 2675) |
| I105F03 | 701 | 141 - 249 | 163 - 173 | 189 - 195 | 228 - 238 | 1 - 123 | 26 - 35 | 50 - 66 | 99 - 112 | SRDLLLFPHHPLDS (SEQ ID NO: 2409) |
| I105F06 | 702 | 141 - 249 | 163 - 173 | 189 - 195 | 228 - 238 | 1 - 123 | 26 - 35 | 50 - 66 | 99 - 112 | SRDLLLFPQAPLHP (SEQ ID NO: 2691) |
| I105F07 | 703 | 141 - 249 | 163 - 173 | 189 - 195 | 228 - 238 | 1 - 123 | 26 - 35 | 50 - 66 | 99 - 112 | SRDLLLFPSWPLTF (SEQ ID NO: 2340) |
| I105F09 | 704 | 141 - 249 | 163 - 173 | 189 - 195 | 228 - 238 | 1 - 123 | 26 - 35 | 50 - 66 | 99 - 112 | SRDLLLFPHYPLLF (SEQ ID NO: 2344) |
| I105F12 | 705 | 141 - 249 | 163 - 173 | 189 - 195 | 228 - 238 | 1 - 123 | 26 - 35 | 50 - 66 | 99 - 112 | SRDLLLFPTYPLVF (SEQ ID NO: 2604) |
| I105G03 | 706 | 141 - 249 | 163 - 173 | 189 - 195 | 228 - 238 | 1 - 123 | 26 - 35 | 50 - 66 | 99 - 112 | SRDLLLFPHAPLHP (SEQ ID NO: 2370) |
| I105G08 | 707 | 141 - 249 | 163 - 173 | 189 - 195 | 228 - 238 | 1 - 123 | 26 - 35 | 50 - 66 | 99 - 112 | SRDLLLFPKHPLVF (SEQ ID NO: 2366) |

| | | | | | | | | | | |
|---|---|---|---|---|---|---|---|---|---|---|
| 1105G09 | 708 | 141 - 249 | 163 - 173 | 189 - 195 | 228 - 238 | 1 - 123 | 26 - 35 | 50 - 66 | 99 - 112 | SRDLLLFPASPLNP (SEQ ID NO: 2364) |
| 1105G10 | 709 | 141 - 249 | 163 - 173 | 189 - 195 | 228 - 238 | 1 - 123 | 26 - 35 | 50 - 66 | 99 - 112 | SRDLLLFPHHSFDA (SEQ ID NO: 2419) |
| 1105G11 | 710 | 141 - 249 | 163 - 173 | 189 - 195 | 228 - 238 | 1 - 123 | 26 - 35 | 50 - 66 | 99 - 112 | SRDLLLFPHDPLLF (SEQ ID NO: 2614) |
| 1107A01 | 711 | 141 - 249 | 163 - 173 | 189 - 195 | 228 - 238 | 1 - 123 | 26 - 35 | 50 - 66 | 99 - 112 | SRDLLLFPRHPLVF (SEQ ID NO: 2545) |
| 1107A03 | 712 | 141 - 249 | 163 - 173 | 189 - 195 | 228 - 238 | 1 - 123 | 26 - 35 | 50 - 66 | 99 - 112 | SRDLLLFPRAPLYP (SEQ ID NO: 2501) |
| 1107A06 | 713 | 141 - 249 | 163 - 173 | 189 - 195 | 228 - 238 | 1 - 123 | 26 - 35 | 50 - 66 | 99 - 112 | SRDLLLFPHAPLDP (SEQ ID NO: 2369) |
| 1107A07 | 714 | 141 - 249 | 163 - 173 | 189 - 195 | 228 - 238 | 1 - 123 | 26 - 35 | 50 - 66 | 99 - 112 | SRDLLLFPNAPLSP (SEQ ID NO: 2371) |
| 1107A09 | 715 | 141 - 249 | 163 - 173 | 189 - 195 | 228 - 238 | 1 - 123 | 26 - 35 | 50 - 66 | 99 - 112 | SRDLLLFPQAPLSP (SEQ ID NO: 2699) |
| 1107A12 | 716 | 141 - 249 | 163 - 173 | 189 - 195 | 228 - 238 | 1 - 123 | 26 - 35 | 50 - 66 | 99 - 112 | SRDLLLFPHAPLSF (SEQ ID NO: 2564) |
| 1107B02 | 717 | 141 - 249 | 163 - 173 | 189 - 195 | 228 - 238 | 1 - 123 | 26 - 35 | 50 - 66 | 99 - 112 | SRDLLLFPHAPLFP (SEQ ID NO: 2533) |
| 1107B04 | 718 | 141 - 249 | 163 - 173 | 189 - 195 | 228 - 238 | 1 - 123 | 26 - 35 | 50 - 66 | 99 - 112 | SRDLLLFPASPLTF (SEQ ID NO: 2420) |
| 1107B05 | 719 | 141 - 249 | 163 - 173 | 189 - 195 | 228 - 238 | 1 - 123 | 26 - 35 | 50 - 66 | 99 - 112 | SRDLLLFPHYGMDV (SEQ ID NO: 2133) |
| 1107C01 | 720 | 139 - 247 | 161 - 171 | 187 - 193 | 226 - 236 | 1 - 121 | 24 - 33 | 48 - 64 | 97 - 110 | SRDLLLFPHYPLLF (SEQ ID NO: 2344) |
| 1107C02 | 721 | 141 - 249 | 163 - 173 | 189 - 195 | 228 - 238 | 1 - 123 | 26 - 35 | 50 - 66 | 99 - 112 | SRDLLLFPHYGMYV (SEQ ID NO: 2504) |
| 1107C04 | 722 | 141 - 249 | 163 - 173 | 189 - 195 | 228 - 238 | 1 - 123 | 26 - 35 | 50 - 66 | 99 - 112 | SRDLLLFPHYPLHP (SEQ ID NO: 2357) |
| 1107C06 | 723 | 141 - 249 | 163 - 173 | 189 - 195 | 228 - 238 | 1 - 123 | 26 - 35 | 50 - 66 | 99 - 112 | SRDLLLFPHAPLAP (SEQ ID NO: 2510) |
| 1107C08 | 724 | 141 - 249 | 163 - 173 | 189 - 195 | 228 - 238 | 1 - 123 | 26 - 35 | 50 - 66 | 99 - 112 | SRDLLLFPQAPLEP (SEQ ID NO: 2681) |
| 1107C10 | 725 | 141 - 249 | 163 - 173 | 189 - 195 | 228 - 238 | 1 - 123 | 26 - 35 | 50 - 66 | 99 - 112 | SRDLLLFPSHAFDL (SEQ ID NO: 2674) |
| 1107D01 | 725 | 141 - 249 | 163 - 173 | 189 - 195 | 228 - 238 | 1 - 123 | 26 - 35 | 50 - 66 | 99 - 112 | SRDLLLFPYAPLDF (SEQ ID NO: 2361) |
| 1107D04 | 727 | 141 - 249 | 163 - 173 | 189 - 195 | 228 - 238 | 1 - 123 | 26 - 35 | 50 - 66 | 99 - 112 | SRDLLLFPNAPLSF (SEQ ID NO: 2625) |
| 1107D07 | 728 | 141 - 249 | 163 - 173 | 189 - 195 | 228 - 238 | 1 - 123 | 26 - 35 | 50 - 66 | 99 - 112 | SRDLLLFPSHSFDV (SEQ ID NO: 2693) |
| 1107D12 | 729 | 141 - 249 | 163 - 173 | 189 - 195 | 228 - 238 | 1 - 123 | 26 - 35 | 50 - 66 | 99 - 112 | SRDLLLFPHHSFDT (SEQ ID NO: 2424) |
| 1107E01 | 730 | 141 - 249 | 163 - 173 | 189 - 195 | 228 - 238 | 1 - 123 | 26 - 35 | 50 - 66 | 99 - 112 | SRDLLLFPMLGLDL (SEQ ID NO: 2499) |
| 1107E05 | 731 | 141 - 249 | 163 - 173 | 189 - 195 | 228 - 238 | 1 - 123 | 26 - 35 | 50 - 66 | 99 - 112 | SRDLLLFPRAPLDF (SEQ ID NO: 2367) |
| 1107E07 | 732 | 141 - 249 | 163 - 173 | 189 - 195 | 228 - 238 | 1 - 123 | 26 - 35 | 50 - 66 | 99 - 112 | SRDLLLFPKSPLLF (SEQ ID NO: 2551) |
| 1107E09 | 733 | 141 - 249 | 163 - 173 | 189 - 195 | 228 - 238 | 1 - 123 | 26 - 35 | 50 - 66 | 99 - 112 | SRDLLLFPKAPLTF (SEQ ID NO: 2382) |
| 1107F01 | 734 | 141 - 249 | 163 - 173 | 189 - 195 | 228 - 238 | 1 - 123 | 26 - 35 | 50 - 66 | 99 - 112 | SRDLLLFPSAPLSF (SEQ ID NO: 2623) |
| 1107F05 | 735 | 141 - 249 | 163 - 173 | 189 - 195 | 228 - 238 | 1 - 123 | 26 - 35 | 50 - 66 | 99 - 112 | SRDLLLFPHAPLAP (SEQ ID NO: 2510) |
| 1107F09 | 736 | 141 - 249 | 163 - 173 | 189 - 195 | 228 - 238 | 1 - 123 | 26 - 35 | 50 - 66 | 99 - 112 | SRDLLLFPSAPLAP (SEQ ID NO: 2394) |
| 1107F10 | 737 | 141 - 249 | 163 - 173 | 189 - 195 | 228 - 238 | 1 - 123 | 26 - 35 | 50 - 66 | 99 - 112 | SRDLLLFPRTPLLF (SEQ ID NO: 2373) |
| 1107G01 | 738 | 141 - 249 | 163 - 173 | 189 - 195 | 228 - 238 | 1 - 123 | 26 - 35 | 50 - 66 | 99 - 112 | SRDLLLFPNAPLSP (SEQ ID NO: 2371) |
| 1107G05 | 739 | 141 - 249 | 163 - 173 | 189 - 195 | 228 - 238 | 1 - 123 | 26 - 35 | 50 - 66 | 99 - 112 | SRDLLLFPSAPLYP (SEQ ID NO: 2387) |
| 1107H02 | 740 | 141 - 249 | 163 - 173 | 189 - 195 | 228 - 238 | 1 - 123 | 26 - 35 | 50 - 66 | 99 - 112 | SRDLLLFPHHSFDL (SEQ ID NO: 2147) |
| 1107H06 | 741 | 141 - 249 | 163 - 173 | 189 - 195 | 228 - 238 | 1 - 123 | 26 - 35 | 50 - 66 | 99 - 112 | SRDLLLFPRAPLSF (SEQ ID NO: 2496) |
| 1107H09 | 742 | 141 - 249 | 163 - 173 | 189 - 195 | 228 - 238 | 1 - 123 | 26 - 35 | 50 - 66 | 99 - 112 | SRDLLLFPHYPLEM (SEQ ID NO: 2536) |
| 1107H10 | 743 | 141 - 249 | 163 - 173 | 189 - 195 | 228 - 238 | 1 - 123 | 26 - 35 | 50 - 66 | 99 - 112 | SRDLLLFPHAPLAP (SEQ ID NO: 2510) |
| 1108A12 | 744 | 141 - 249 | 163 - 173 | 189 - 195 | 228 - 238 | 1 - 123 | 26 - 35 | 50 - 66 | 99 - 112 | SRDLLLFPHHSFDL (SEQ ID NO: 2147) |
| 1108B03 | 745 | 141 - 249 | 163 - 173 | 189 - 195 | 228 - 238 | 1 - 123 | 26 - 35 | 50 - 66 | 99 - 112 | SRDLLLFPRDPLLF (SEQ ID NO: 2515) |
| 1108B04 | 746 | 141 - 249 | 163 - 173 | 189 - 195 | 228 - 238 | 1 - 123 | 26 - 35 | 50 - 66 | 99 - 112 | SRDLLLFPLSPLVP (SEQ ID NO: 2396) |
| 1108C09 | 747 | 141 - 249 | 163 - 173 | 189 - 195 | 228 - 238 | 1 - 123 | 26 - 35 | 50 - 66 | 99 - 112 | SRDLLLFPHDPLGF (SEQ ID NO: 2353) |
| 1108C11 | 748 | 141 - 249 | 163 - 173 | 189 - 195 | 228 - 238 | 1 - 123 | 26 - 35 | 50 - 66 | 99 - 112 | SRDLLLFPHHSLLF (SEQ ID NO: 2429) |
| 1108D10 | 749 | 141 - 249 | 163 - 173 | 189 - 195 | 228 - 238 | 1 - 123 | 26 - 35 | 50 - 66 | 99 - 112 | SRDLLLFPASPLNP (SEQ ID NO: 2364) |

| | | | | | | | | | |
|---|---|---|---|---|---|---|---|---|---|
| I108D11 | 750 | 141 - 249 | 163 - 173 | 189 - 195 | 228 - 238 | 1 - 123 | 26 - 35 | 50 - 66 | 99 - 112 | SRDLLLFPASPLNP (SEQ ID NO: 2364) |
| I108D12 | 751 | 141 - 249 | 163 - 173 | 189 - 195 | 228 - 238 | 1 - 123 | 26 - 35 | 50 - 66 | 99 - 112 | SRDLLLFPSAPLNP (SEQ ID NO: 2709) |
| I108E01 | 752 | 141 - 249 | 163 - 173 | 189 - 195 | 228 - 238 | 1 - 123 | 26 - 35 | 50 - 66 | 99 - 112 | SRDLLLFPHHSFDL (SEQ ID NO: 2147) |
| I108E03 | 753 | 141 - 249 | 163 - 173 | 189 - 195 | 228 - 238 | 1 - 123 | 26 - 35 | 50 - 66 | 99 - 112 | SRDLLLFPKHPLRF (SEQ ID NO: 2393) |
| I108E05 | 754 | 141 - 249 | 163 - 173 | 189 - 195 | 228 - 238 | 1 - 123 | 26 - 35 | 50 - 66 | 99 - 112 | SRDLLLFPHAPLFP (SEQ ID NO: 2533) |
| I108E07 | 755 | 141 - 249 | 163 - 173 | 189 - 195 | 228 - 238 | 1 - 123 | 26 - 35 | 50 - 66 | 99 - 112 | SRDLLLFPHAPLDP (SEQ ID NO: 2369) |
| I108E08 | 756 | 141 - 249 | 163 - 173 | 189 - 195 | 228 - 238 | 1 - 123 | 26 - 35 | 50 - 66 | 99 - 112 | SRDLLLFPHYPLLF (SEQ ID NO: 2344) |
| I108E09 | 757 | 141 - 249 | 163 - 173 | 189 - 195 | 228 - 238 | 1 - 123 | 26 - 35 | 50 - 66 | 99 - 112 | SRDLLLFPSAPLSP (SEQ ID NO: 2623) |
| I108E10 | 758 | 141 - 249 | 163 - 173 | 189 - 195 | 228 - 238 | 1 - 123 | 26 - 35 | 50 - 66 | 99 - 112 | SRDLLLFPRDPLDL (SEQ ID NO: 2509) |
| I108E11 | 759 | 141 - 249 | 163 - 173 | 189 - 195 | 228 - 238 | 1 - 123 | 26 - 35 | 50 - 66 | 99 - 112 | SRDLLLFPRDPLEF (SEQ ID NO: 2516) |
| I108F10 | 760 | 141 - 249 | 163 - 173 | 189 - 195 | 228 - 238 | 1 - 123 | 26 - 35 | 50 - 66 | 99 - 112 | SRDLLLFPNAPLSP (SEQ ID NO: 2371) |
| I108F12 | 761 | 141 - 249 | 163 - 173 | 189 - 195 | 228 - 238 | 1 - 123 | 26 - 35 | 50 - 66 | 99 - 112 | SRDLLLFPHYPFDA (SEQ ID NO: 2508) |
| I108G01 | 762 | 141 - 249 | 163 - 173 | 189 - 195 | 228 - 238 | 1 - 123 | 26 - 35 | 50 - 66 | 99 - 112 | SRDLLLFPRDPLRF (SEQ ID NO: 2360) |
| I108G02 | 763 | 141 - 249 | 163 - 173 | 189 - 195 | 228 - 238 | 1 - 123 | 26 - 35 | 50 - 66 | 99 - 112 | SRDLLLFPDAPLAP (SEQ ID NO: 2381) |
| I108G07 | 764 | 141 - 249 | 163 - 173 | 189 - 195 | 228 - 238 | 1 - 123 | 26 - 35 | 50 - 66 | 99 - 112 | SRDLLLFPRAPLAP (SEQ ID NO: 2476) |
| I108G10 | 765 | 141 - 249 | 163 - 173 | 189 - 195 | 228 - 238 | 1 - 123 | 26 - 35 | 50 - 66 | 99 - 112 | SRDLLLFPHHSLLF (SEQ ID NO: 2429) |
| I108G11 | 766 | 141 - 249 | 163 - 173 | 189 - 195 | 228 - 238 | 1 - 123 | 26 - 35 | 50 - 66 | 99 - 112 | SRDLLLFPHHPLTF (SEQ ID NO: 2377) |
| I108G12 | 767 | 141 - 249 | 163 - 173 | 189 - 195 | 228 - 238 | 1 - 123 | 26 - 35 | 50 - 66 | 99 - 112 | SRDLLLFPHHPLTF (SEQ ID NO: 2377) |
| I108H01 | 768 | 141 - 249 | 163 - 173 | 189 - 195 | 228 - 238 | 1 - 123 | 26 - 35 | 50 - 66 | 99 - 112 | SRDLLLFPRDPLHP (SEQ ID NO: 2512) |
| I108H02 | 769 | 141 - 249 | 163 - 173 | 189 - 195 | 228 - 238 | 1 - 123 | 26 - 35 | 50 - 66 | 99 - 112 | SRDLLLFPNAPLNP (SEQ ID NO: 2615) |
| I108H06 | 770 | 141 - 249 | 163 - 173 | 189 - 195 | 228 - 238 | 1 - 123 | 26 - 35 | 50 - 66 | 99 - 112 | SRDLLLFPHHSFDL (SEQ ID NO: 2147) |
| I108H08 | 771 | 141 - 249 | 163 - 173 | 189 - 195 | 228 - 238 | 1 - 123 | 26 - 35 | 50 - 66 | 99 - 112 | SRDLLLFPASPLNP (SEQ ID NO: 2364) |
| I111A06 | 772 | 141 - 249 | 163 - 173 | 189 - 195 | 228 - 238 | 1 - 123 | 26 - 35 | 50 - 66 | 99 - 112 | SRDLLLFPQAPLHP (SEQ ID NO: 2691) |
| I111B12 | 773 | 141 - 249 | 163 - 173 | 189 - 195 | 228 - 238 | 1 - 123 | 26 - 35 | 50 - 66 | 99 - 112 | SRDLLLFPHHSFDL (SEQ ID NO: 2147) |
| I111C01 | 774 | 141 - 249 | 163 - 173 | 189 - 195 | 228 - 238 | 1 - 123 | 26 - 35 | 50 - 66 | 99 - 112 | SRDLLLFPQHGLDL (SEQ ID NO: 2449) |
| I111D06 | 775 | 141 - 249 | 163 - 173 | 189 - 195 | 228 - 238 | 1 - 123 | 26 - 35 | 50 - 66 | 99 - 112 | SRDLLLFPRDPLLF (SEQ ID NO: 2515) |
| I111E04 | 776 | 141 - 249 | 163 - 173 | 189 - 195 | 228 - 238 | 1 - 123 | 26 - 35 | 50 - 66 | 99 - 112 | SRDLLLFPHHSFDL (SEQ ID NO: 2147) |
| I111E10 | 777 | 141 - 249 | 163 - 173 | 189 - 195 | 228 - 238 | 1 - 123 | 26 - 35 | 50 - 66 | 99 - 112 | SRDLLLFPQAPLHP (SEQ ID NO: 2691) |
| I111E11 | 778 | 141 - 250 | 163 - 173 | 189 - 195 | 229 - 239 | 1 - 123 | 26 - 35 | 50 - 66 | 99 - 112 | SRDLLLFPHYPLLF (SEQ ID NO: 2344) |
| I111E12 | 779 | 141 - 249 | 163 - 173 | 189 - 195 | 228 - 238 | 1 - 123 | 26 - 35 | 50 - 66 | 99 - 112 | SRYLLLFPHHSFDL (SEQ ID NO: 2150) |
| I111F07 | 780 | 141 - 249 | 163 - 173 | 189 - 195 | 228 - 238 | 1 - 123 | 26 - 35 | 50 - 66 | 99 - 112 | SRDLLLFPRAPLYP (SEQ ID NO: 2501) |
| I111G02 | 781 | 141 - 249 | 163 - 173 | 189 - 195 | 228 - 238 | 1 - 123 | 26 - 35 | 50 - 66 | 99 - 112 | SRDLLLFPKAPLDF (SEQ ID NO: 2534) |
| I111H10 | 782 | 141 - 249 | 163 - 173 | 189 - 195 | 228 - 238 | 1 - 123 | 26 - 35 | 50 - 66 | 99 - 112 | SRYLLLFPQHGFDA (SEQ ID NO: 2703) |
| I113A04 | 783 | 141 - 249 | 163 - 173 | 189 - 195 | 228 - 238 | 1 - 123 | 26 - 35 | 50 - 66 | 99 - 112 | SRDLLLFPSAPLWP (SEQ ID NO: 2352) |
| I113A12 | 784 | 141 - 249 | 163 - 173 | 189 - 195 | 228 - 238 | 1 - 123 | 26 - 35 | 50 - 66 | 99 - 112 | SRDLLLFPQEPLAP (SEQ ID NO: 2434) |
| I113B06 | 785 | 141 - 249 | 163 - 173 | 189 - 195 | 228 - 238 | 1 - 123 | 26 - 35 | 50 - 66 | 99 - 112 | SRDLLLFPHHPLEP (SEQ ID NO: 2411) |
| I113C06 | 786 | 141 - 249 | 163 - 173 | 189 - 195 | 228 - 238 | 1 - 123 | 26 - 35 | 50 - 66 | 99 - 112 | SRDLLLFPHHGFDA (SEQ ID NO: 2406) |
| I113G04 | 787 | 141 - 249 | 163 - 173 | 189 - 195 | 228 - 238 | 1 - 123 | 26 - 35 | 50 - 66 | 99 - 112 | SRDLLLFPHYPLLF (SEQ ID NO: 2344) |
| I113G05 | 788 | 141 - 249 | 163 - 173 | 189 - 195 | 228 - 238 | 1 - 123 | 26 - 35 | 50 - 66 | 99 - 112 | SRDLLLFPHYSLLL (SEQ ID NO: 2517) |
| I113G10 | 789 | 141 - 249 | 163 - 173 | 189 - 195 | 228 - 238 | 1 - 123 | 26 - 35 | 50 - 66 | 99 - 112 | SRDLLLFPHHPLQF (SEQ ID NO: 2413) |
| I113G11 | 790 | 141 - 249 | 163 - 173 | 189 - 195 | 228 - 238 | 1 - 123 | 26 - 35 | 50 - 66 | 99 - 112 | SRDLLLFPHYPLLF (SEQ ID NO: 2344) |
| I113H06 | 791 | 141 - 249 | 163 - 173 | 189 - 195 | 228 - 238 | 1 - 123 | 26 - 35 | 50 - 66 | 99 - 112 | SRDLLLFPHYPLLF (SEQ ID NO: 2344) |

| | | | | | | | | | | |
|---|---|---|---|---|---|---|---|---|---|---|
| I113H07 | 792 | 141 - 249 | 163 - 173 | 189 - 195 | 228 - 238 | 1 - 123 | 26 - 35 | 50 - 66 | 99 - 112 | SRDLLLFPHHSFDL (SEQ ID NO: 2147) |
| I113H09 | 793 | 141 - 249 | 163 - 173 | 189 - 195 | 228 - 238 | 1 - 123 | 26 - 35 | 50 - 66 | 99 - 112 | SRDLLLFPHYTLLF (SEQ ID NO: 2525) |
| I114C04 | 794 | 141 - 249 | 163 - 173 | 189 - 195 | 228 - 238 | 1 - 123 | 26 - 35 | 50 - 66 | 99 - 112 | SRDLLLFPHHGFDA (SEQ ID NO: 2406) |
| I114C12 | 795 | 141 - 249 | 163 - 173 | 189 - 195 | 228 - 238 | 1 - 123 | 26 - 35 | 50 - 66 | 99 - 112 | SRDLLLFPQAPLHP (SEQ ID NO: 2691) |
| I114D04 | 796 | 141 - 249 | 163 - 173 | 189 - 195 | 228 - 238 | 1 - 123 | 26 - 35 | 50 - 66 | 99 - 112 | SRDLLLFPHYGMDV (SEQ ID NO: 2133) |
| I114D06 | 797 | 141 - 249 | 163 - 173 | 189 - 195 | 228 - 238 | 1 - 123 | 26 - 35 | 50 - 66 | 99 - 112 | SRDLLLFPHHSFDL (SEQ ID NO: 2147) |
| I114D10 | 798 | 141 - 249 | 163 - 173 | 189 - 195 | 228 - 238 | 1 - 123 | 26 - 35 | 50 - 66 | 99 - 112 | SRDLLLFPHYSLVL (SEQ ID NO: 2521) |
| I114E01 | 799 | 141 - 249 | 163 - 173 | 189 - 195 | 228 - 238 | 1 - 123 | 26 - 35 | 50 - 66 | 99 - 112 | SRDLLLFPQEPLSP (SEQ ID NO: 2435) |
| I114E02 | 800 | 141 - 249 | 163 - 173 | 189 - 195 | 228 - 238 | 1 - 123 | 26 - 35 | 50 - 66 | 99 - 112 | SRDLLLFPQESFSL (SEQ ID NO: 2437) |
| I114E03 | 801 | 141 - 249 | 163 - 173 | 189 - 195 | 228 - 238 | 1 - 123 | 26 - 35 | 50 - 66 | 99 - 112 | SRDLLLFPKAPLTF (SEQ ID NO: 2382) |
| I114B11 | 802 | 141 - 249 | 163 - 173 | 189 - 195 | 228 - 238 | 1 - 123 | 26 - 35 | 50 - 66 | 99 - 112 | SRDLLLFPHDSFFL (SEQ ID NO: 2383) |
| I114H01 | 803 | 141 - 249 | 163 - 173 | 189 - 195 | 228 - 238 | 1 - 123 | 26 - 35 | 50 - 66 | 99 - 112 | SRDLLLFPHHSFDL (SEQ ID NO: 2147) |
| I114H06 | 804 | 141 - 249 | 163 - 173 | 189 - 195 | 228 - 238 | 1 - 123 | 26 - 35 | 50 - 66 | 99 - 112 | SRDLLLFPHHALDV (SEQ ID NO: 2404) |
| I114H09 | 805 | 141 - 249 | 163 - 173 | 189 - 195 | 228 - 238 | 1 - 123 | 26 - 35 | 50 - 66 | 99 - 112 | SRDLLLFPHHSFDL (SEQ ID NO: 2147) |
| I115A02 | 806 | 141 - 249 | 163 - 173 | 189 - 195 | 228 - 238 | 1 - 123 | 26 - 35 | 50 - 66 | 99 - 112 | SRYLLLFPDHSFDL (SEQ ID NO: 2684) |
| I115A07 | 807 | 141 - 249 | 163 - 173 | 189 - 195 | 228 - 238 | 1 - 123 | 26 - 35 | 50 - 66 | 99 - 112 | SRDLLLFPHYPLLF (SEQ ID NO: 2344) |
| I115B10 | 808 | 141 - 249 | 163 - 173 | 189 - 195 | 228 - 238 | 1 - 123 | 26 - 35 | 50 - 66 | 99 - 112 | SRDLLLFPHHSFDL (SEQ ID NO: 2147) |
| I115C05 | 809 | 141 - 249 | 163 - 173 | 189 - 195 | 228 - 238 | 1 - 123 | 26 - 35 | 50 - 66 | 99 - 112 | SRDLLLFPRAPLYP (SEQ ID NO: 2501) |
| I115C06 | 810 | 141 - 249 | 163 - 173 | 189 - 195 | 228 - 238 | 1 - 123 | 26 - 35 | 50 - 66 | 99 - 112 | SRYLLLFPHHSFDL (SEQ ID NO: 2150) |
| I115C08 | 811 | 141 - 249 | 163 - 173 | 189 - 195 | 228 - 238 | 1 - 123 | 26 - 35 | 50 - 66 | 99 - 112 | SRDLLLFPHHSFDL (SEQ ID NO: 2147) |
| I115C12 | 812 | 141 - 249 | 163 - 173 | 189 - 195 | 228 - 238 | 1 - 123 | 26 - 35 | 50 - 66 | 99 - 112 | SRDLLLFPHHSFDT (SEQ ID NO: 2424) |
| I115D07 | 813 | 141 - 249 | 163 - 173 | 189 - 195 | 228 - 238 | 1 - 123 | 26 - 35 | 50 - 66 | 99 - 112 | SRDLLLFPHYPLLF (SEQ ID NO: 2344) |
| I115E09 | 814 | 141 - 249 | 163 - 173 | 189 - 195 | 228 - 238 | 1 - 123 | 26 - 35 | 50 - 66 | 99 - 112 | SRDLLLFPHHRFDL (SEQ ID NO: 2418) |
| I115F06 | 815 | 141 - 249 | 163 - 173 | 189 - 195 | 228 - 238 | 1 - 123 | 26 - 35 | 50 - 66 | 99 - 112 | SRYLLLFPHYGMDV (SEQ ID NO: 2685) |
| I115F07 | 816 | 141 - 249 | 163 - 173 | 189 - 195 | 228 - 238 | 1 - 123 | 26 - 35 | 50 - 66 | 99 - 112 | SRYLLLFPHYPLLF (SEQ ID NO: 2686) |
| I115F12 | 817 | 141 - 249 | 163 - 173 | 189 - 195 | 228 - 238 | 1 - 123 | 26 - 35 | 50 - 66 | 99 - 112 | SRYLLLFPHHSFDL (SEQ ID NO: 2150) |
| I115G04 | 818 | 141 - 249 | 163 - 173 | 189 - 195 | 228 - 238 | 1 - 123 | 26 - 35 | 50 - 66 | 99 - 112 | SRDLLLFPHHRFDL (SEQ ID NO: 2418) |
| I115G05 | 819 | 141 - 249 | 163 - 173 | 189 - 195 | 228 - 238 | 1 - 123 | 26 - 35 | 50 - 66 | 99 - 112 | SRDLLLFPHYPLLF (SEQ ID NO: 2344) |
| I115G08 | 820 | 141 - 249 | 163 - 173 | 189 - 195 | 228 - 238 | 1 - 123 | 26 - 35 | 50 - 66 | 99 - 112 | SRDLLLFPHDSFDL (SEQ ID NO: 2631) |
| I115H04 | 821 | 141 - 249 | 163 - 173 | 189 - 195 | 228 - 238 | 1 - 123 | 26 - 35 | 50 - 66 | 99 - 112 | SRDLLLFPHANLSP (SEQ ID NO: 2503) |
| I115H07 | 822 | 141 - 249 | 163 - 173 | 189 - 195 | 228 - 238 | 1 - 123 | 26 - 35 | 50 - 66 | 99 - 112 | SRDLLLFPHYPLLF (SEQ ID NO: 2344) |
| I115H09 | 823 | 141 - 249 | 163 - 173 | 189 - 195 | 228 - 238 | 1 - 123 | 26 - 35 | 50 - 66 | 99 - 112 | SRDLLLFPHHRFDL (SEQ ID NO: 2418) |
| I116A07 | 824 | 141 - 249 | 163 - 173 | 189 - 195 | 228 - 238 | 1 - 123 | 26 - 35 | 50 - 66 | 99 - 112 | SRDLLLFPYEPLRF (SEQ ID NO: 2642) |
| I116B01 | 825 | 141 - 249 | 163 - 173 | 189 - 195 | 228 - 238 | 1 - 123 | 26 - 35 | 50 - 66 | 99 - 112 | SRDLLLFPHHSFDL (SEQ ID NO: 2147) |
| I116B12 | 826 | 141 - 249 | 163 - 173 | 189 - 195 | 228 - 238 | 1 - 123 | 26 - 35 | 50 - 66 | 99 - 112 | SRDLLLFPHHSFDL (SEQ ID NO: 2147) |
| I116C06 | 827 | 141 - 249 | 163 - 173 | 189 - 195 | 228 - 238 | 1 - 123 | 26 - 35 | 50 - 66 | 99 - 112 | SRDLLLFPHYPLLF (SEQ ID NO: 2344) |
| I116D07 | 828 | 141 - 249 | 163 - 173 | 189 - 195 | 228 - 238 | 1 - 123 | 26 - 35 | 50 - 66 | 99 - 112 | SRDLLLFPHHSFDL (SEQ ID NO: 2147) |
| I116E02 | 829 | 141 - 249 | 163 - 173 | 189 - 195 | 228 - 238 | 1 - 123 | 26 - 35 | 50 - 66 | 99 - 112 | SRDLLLFPHHRFDL (SEQ ID NO: 2418) |
| I116E04 | 830 | 141 - 249 | 163 - 173 | 189 - 195 | 228 - 238 | 1 - 123 | 26 - 35 | 50 - 66 | 99 - 112 | SRDLLLFPHHSFDL (SEQ ID NO: 2147) |
| I116F02 | 831 | 141 - 249 | 163 - 173 | 189 - 195 | 228 - 238 | 1 - 123 | 26 - 35 | 50 - 66 | 99 - 112 | SRYLLLFPHHSFDL (SEQ ID NO: 2150) |
| I116F11 | 832 | 141 - 249 | 163 - 173 | 189 - 195 | 228 - 238 | 1 - 123 | 26 - 35 | 50 - 66 | 99 - 112 | SRDLLLFPHYPLLF (SEQ ID NO: 2344) |
| I116G05 | 833 | 141 - 249 | 163 - 173 | 189 - 195 | 228 - 238 | 1 - 123 | 26 - 35 | 50 - 66 | 99 - 112 | SRDLLLFPQAPLSP (SEQ ID NO: 2699) |

| | | | | | | | | | |
|---|---|---|---|---|---|---|---|---|---|
| I001C09 | 834 | 143 - 250 | 164 - 174 | 190 - 196 | 229 - 239 | 1 - 127 | 26 - 35 | 50 - 66 | 99 - 116 DGSYDILTGYYIDNYMDV (SEQ ID NO: 2154) |
| I006D07 | 835 | 141 - 248 | 162 - 172 | 188 - 194 | 227 - 237 | 1 - 125 | 26 - 35 | 50 - 66 | 99 - 114 SHYDILTGLNYWYFDL (SEQ ID NO: 2166) |
| I007B03 | 836 | 143 - 253 | 165 - 178 | 194 - 200 | 233 - 242 | 1 - 127 | 26 - 35 | 50 - 66 | 99 - 116 DGSYDILTGYYIDNYMDV (SEQ ID NO: 2154) |
| I007F11 | 837 | 140 - 250 | 162 - 175 | 191 - 197 | 230 - 239 | 1 - 124 | 26 - 35 | 50 - 66 | 99 - 113 DGIDILLVPAALMDV (SEQ ID NO: 2160) |
| I007H08 | 838 | 144 - 254 | 166 - 179 | 195 - 201 | 234 - 243 | 1 - 128 | 26 - 37 | 52 - 69 | 102 - 117 DRYDILTGYYYYGMDV (SEQ ID NO: 2129) |
| I008A09 | 839 | 146 - 256 | 168 - 181 | 197 - 203 | 236 - 245 | 1 - 130 | 26 - 35 | 50 - 66 | 99 - 119 DREAYYDILTGYYLYYYYMDV (SEQ ID NO: 2172) |
| I008B01 | 840 | 141 - 251 | 163 - 176 | 192 - 198 | 231 - 240 | 1 - 125 | 26 - 35 | 50 - 66 | 99 - 114 ATYDPLTGYSFDGFDI (SEQ ID NO: 2153) |
| I008C02 | 841 | 145 - 255 | 167 - 180 | 196 - 202 | 235 - 244 | 1 - 129 | 26 - 37 | 52 - 67 | 100 - 118 HVRDYDILTGYYRGHYFDY (SEQ ID NO: 2167) |
| I008C03 | 842 | 143 - 250 | 164 - 174 | 190 - 196 | 229 - 239 | 1 - 127 | 26 - 35 | 50 - 65 | 98 - 116 EGSYDILTGYYVGVGRMDV (SEQ ID NO: 2171) |
| I008C12 | 843 | 146 - 256 | 168 - 181 | 197 - 203 | 236 - 245 | 1 - 130 | 26 - 35 | 50 - 68 | 101 - 119 FNPTYDILTGYYIGGYFQH (SEQ ID NO: 2155) |
| I012A06 | 844 | 147 - 254 | 169 - 179 | 195 - 201 | 234 - 243 | 1 - 129 | 26 - 37 | 52 - 67 | 100 - 118 GRWDYDLLTGEHLGYYFDY (SEQ ID NO: 2162) |
| I016E05 | 845 | 141 - 251 | 163 - 176 | 192 - 198 | 231 - 240 | 1 - 125 | 26 - 35 | 50 - 65 | 99 - 114 ATYDPLTGYSFDGFDI (SEQ ID NO: 2153) |
| I016F02 | 846 | 135 - 245 | 157 - 170 | 186 - 192 | 225 - 234 | 1 - 119 | 26 - 35 | 50 - 65 | 99 - 108 GMGDHYGMDV (SEQ ID NO: 2161) |
| I016F04 | 847 | 141 - 251 | 163 - 176 | 192 - 198 | 231 - 240 | 1 - 125 | 26 - 35 | 50 - 66 | 99 - 114 ATYDPLTGYSFDGFDI (SEQ ID NO: 2153) |
| I016H07 | 848 | 141 - 248 | 162 - 172 | 188 - 194 | 227 - 237 | 1 - 125 | 26 - 35 | 50 - 65 | 99 - 114 GYHDPLTSYNYNWFDP (SEQ ID NO: 2163) |
| I018C02 | 849 | 141 - 251 | 163 - 176 | 192 - 198 | 231 - 240 | 1 - 125 | 26 - 35 | 50 - 66 | 99 - 114 ATYDPLTGYSFDGFDI (SEQ ID NO: 2153) |
| I018C10 | 850 | 143 - 250 | 164 - 174 | 190 - 196 | 229 - 239 | 1 - 127 | 26 - 35 | 50 - 65 | 99 - 116 DGSYDILTGYYIDNYMDV (SEQ ID NO: 2154) |
| I018D07 | 851 | 143 - 250 | 164 - 174 | 190 - 196 | 229 - 239 | 1 - 127 | 26 - 35 | 50 - 66 | 99 - 116 DGSYDILTGYYIDNYMDV (SEQ ID NO: 2154) |
| I018H08 | 852 | 141 - 251 | 163 - 176 | 192 - 198 | 231 - 240 | 1 - 125 | 26 - 35 | 50 - 66 | 99 - 114 ATYDPLTGYSFDGFDI (SEQ ID NO: 2153) |
| I018H09 | 853 | 141 - 251 | 163 - 176 | 192 - 198 | 231 - 240 | 1 - 125 | 26 - 35 | 50 - 66 | 99 - 114 ATYDPLTGYSFDGFDI (SEQ ID NO: 2153) |
| I021B05 | 854 | 143 - 253 | 165 - 178 | 194 - 200 | 233 - 242 | 1 - 127 | 24 - 33 | 48 - 64 | 97 - 116 EGGNYDILTGYYIGNGAFDI (SEQ ID NO: 2158) |
| I022B02 | 855 | 141 - 251 | 163 - 176 | 192 - 198 | 231 - 240 | 1 - 125 | 26 - 35 | 50 - 66 | 99 - 114 ATYDPLTGYSFDGLDI (SEQ ID NO: 2157) |
| I026E03 | 856 | 143 - 251 | 165 - 175 | 191 - 197 | 230 - 240 | 1 - 125 | 26 - 35 | 50 - 66 | 99 - 114 TDYDILTGYPMGYFDP (SEQ ID NO: 2173) |
| I027A07 | 857 | 145 - 255 | 167 - 179 | 195 - 201 | 234 - 244 | 1 - 128 | 26 - 35 | 50 - 66 | 99 - 117 GGEYDILTGYYFGLGVYDY (SEQ ID NO: 2170) |
| I028A06 | 858 | 142 - 253 | 164 - 176 | 192 - 198 | 231 - 242 | 1 - 126 | 26 - 35 | 50 - 66 | 99 - 115 GGDYDILTGLYYYGMDV (SEQ ID NO: 2156) |
| I029D07 | 859 | 141 - 250 | 163 - 176 | 192 - 198 | 231 - 239 | 1 - 125 | 26 - 35 | 50 - 66 | 99 - 114 ATYDPLTGYSFDGFDI (SEQ ID NO: 2153) |
| I029F11 | 860 | 143 - 253 | 165 - 177 | 193 - 199 | 232 - 242 | 1 - 127 | 26 - 35 | 50 - 66 | 99 - 116 DGSYDILTGYYIDNYMDV (SEQ ID NO: 2154) |
| I031C03 | 861 | 138 - 248 | 160 - 172 | 188 - 194 | 227 - 237 | 1 - 121 | 26 - 35 | 50 - 66 | 99 - 110 GYDSSAFRAFDI (SEQ ID NO: 2130) |
| I031C07 | 862 | 148 - 258 | 170 - 183 | 199 - 205 | 238 - 247 | 1 - 131 | 26 - 35 | 50 - 66 | 99 - 120 SSPPRWYDALTGDSSYHSAMDV (SEQ ID NO: 2169) |
| I031F09 | 863 | 145 - 255 | 167 - 179 | 195 - 201 | 234 - 244 | 1 - 127 | 26 - 35 | 50 - 66 | 99 - 116 DEGRDLLTGYYWPNFFDS (SEQ ID NO: 2168) |
| I031G08 | 864 | 148 - 259 | 170 - 182 | 198 - 204 | 237 - 248 | 1 - 131 | 26 - 35 | 50 - 66 | 99 - 120 SSPPKWYDALTGHSSYHSAMDV (SEQ ID NO: 2159) |
| I031G10 | 865 | 148 - 258 | 170 - 182 | 198 - 204 | 237 - 247 | 1 - 131 | 26 - 35 | 50 - 66 | 99 - 120 SSPPKWYDALTGDSSYHSAMDV (SEQ ID NO: 2165) |
| I031G11 | 866 | 145 - 255 | 167 - 179 | 195 - 201 | 234 - 244 | 1 - 127 | 26 - 35 | 50 - 66 | 99 - 116 DEGRDLLTGYYWPNFFDS (SEQ ID NO: 2168) |
| I037E07 | 867 | 140 - 250 | 162 - 175 | 191 - 197 | 230 - 239 | 1 - 124 | 26 - 35 | 50 - 66 | 99 - 113 DGIDILLVPAALMDV (SEQ ID NO: 2160) |
| I037E12 | 868 | 140 - 250 | 162 - 175 | 191 - 197 | 230 - 239 | 1 - 124 | 26 - 35 | 50 - 66 | 99 - 113 DGIDILLVPAALMDV (SEQ ID NO: 2160) |
| I050A07 | 869 | 146 - 257 | 168 - 181 | 197 - 203 | 236 - 246 | 1 - 129 | 26 - 40 | 55 - 71 | 104 - 118 QDNDPLTGYKLGFDY (SEQ ID NO: 2164) |
| I061D02 | 870 | 144 - 254 | 166 - 179 | 195 - 201 | 234 - 243 | 1 - 128 | 26 - 37 | 52 - 69 | 102 - 117 DRYDILTGYYYYGMDV (SEQ ID NO: 2129) |
| I061E07 | 871 | 141 - 251 | 163 - 175 | 191 - 197 | 230 - 240 | 1 - 125 | 26 - 35 | 50 - 66 | 99 - 114 ATYDPLTGYSFDGFDI (SEQ ID NO: 2153) |
| I061H01 | 872 | 146 - 256 | 168 - 181 | 197 - 203 | 236 - 245 | 1 - 130 | 26 - 35 | 50 - 68 | 101 - 119 FNPTYDILTGYYIGGYFQH (SEQ ID NO: 2155) |
| I001A03 | 873 | 144 - 254 | 166 - 179 | 195 - 201 | 234 - 243 | 1 - 128 | 26 - 35 | 50 - 66 | 99 - 117 ERHYYDILTGYQTGYGMDV (SEQ ID NO: 2784) |
| I001A07 | 874 | 141 - 251 | 163 - 176 | 192 - 198 | 231 - 240 | 1 - 125 | 26 - 35 | 50 - 66 | 99 - 114 ATYDPLTGYSFDGFDI (SEQ ID NO: 2153) |
| I001A08 | 875 | 141 - 251 | 163 - 176 | 192 - 198 | 231 - 240 | 1 - 125 | 26 - 35 | 50 - 66 | 99 - 114 ATYDPLTGYSFDGFDI (SEQ ID NO: 2153) |

| | | | | | | | | | | |
|---|---|---|---|---|---|---|---|---|---|---|
| 1001A10 | 876 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1001A12 | 877 | 141 - 248 | 162 - 172 | 188 - 194 | 227 - 237 | 1 - 125 | 26 - 35 | 50 - 66 | 99 - 114 | ATYDPLTGYSFDGFDI (SEQ ID NO: 2153) |
| 1001B02 | 878 | 137 - 247 | 159 - 171 | 187 - 193 | 226 - 236 | 1 - 121 | 26 - 35 | 50 - 66 | 99 - 110 | DRETKVGYGMDV (SEQ ID NO: 2945) |
| 1001B07 | 879 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1001C06 | 880 | 143 - 253 | 165 - 178 | 194 - 200 | 233 - 242 | 1 - 127 | 24 - 33 | 48 - 64 | 97 - 116 | EGGNYDILTGYYIGNGAFDI (SEQ ID NO: 2158) |
| 1001C08 | 881 | 144 - 254 | 166 - 179 | 195 - 201 | 234 - 243 | 1 - 128 | 26 - 35 | 50 - 66 | 99 - 117 | EGSYDILTGYYVGVGRMDV (SEQ ID NO: 2171) |
| 1001C12 | 882 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1001D08 | 883 | 140 - 250 | 162 - 175 | 191 - 197 | 230 - 239 | 1 - 124 | 26 - 35 | 50 - 65 | 98 - 113 | DSYDILTGYRGYYFDY (SEQ ID NO: 2745) |
| 1001D12 | 884 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1001E05 | 885 | 143 - 253 | 165 - 178 | 194 - 200 | 233 - 242 | 1 - 127 | 24 - 33 | 48 - 64 | 97 - 116 | EGGNYDILTGYYIGNGAFDI (SEQ ID NO: 2158) |
| 1001E07 | 886 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1001G09 | 887 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1001H05 | 888 | 144 - 254 | 166 - 179 | 195 - 201 | 234 - 243 | 1 - 128 | 26 - 35 | 50 - 66 | 99 - 117 | ERHYYDILTGYQTGYGMDV (SEQ ID NO: 2784) |
| 1001H08 | 889 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1003A01 | 890 | 141 - 251 | 163 - 176 | 192 - 198 | 231 - 240 | 1 - 124 | 26 - 34 | 49 - 65 | 98 - 113 | ELGSSIVGATTGALDM (SEQ ID NO: 2852) |
| 1003A06 | 891 | 141 - 251 | 163 - 176 | 192 - 198 | 231 - 240 | 1 - 124 | 26 - 34 | 49 - 65 | 98 - 113 | ELGSSIVGATTGALDM (SEQ ID NO: 2852) |
| 1003A07 | 892 | 142 - 249 | 163 - 173 | 189 - 195 | 228 - 238 | 1 - 126 | 26 - 35 | 50 - 66 | 99 - 115 | DGYYDILTGYSYYGMDV (SEQ ID NO: 2135) |
| 1003A10 | 893 | 141 - 248 | 162 - 172 | 188 - 194 | 227 - 237 | 1 - 125 | 26 - 35 | 50 - 66 | 99 - 114 | MEYDILTGYYGGYFDY (SEQ ID NO: 2179) |
| 1003B03 | 894 | 141 - 251 | 163 - 176 | 192 - 198 | 231 - 240 | 1 - 124 | 26 - 34 | 49 - 65 | 98 - 113 | ELGSSIVGATTGALDM (SEQ ID NO: 2852) |
| 1003B04 | 895 | 140 - 248 | 162 - 172 | 188 - 194 | 227 - 237 | 1 - 122 | 25 - 34 | 49 - 65 | 98 - 111 | RYGDPFYYYYYMNV (SEQ ID NO: 2755) |
| 1003B09 | 896 | 142 - 249 | 163 - 173 | 189 - 195 | 228 - 238 | 1 - 126 | 26 - 35 | 50 - 66 | 99 - 115 | DGYYDILTGYSYYGMDV (SEQ ID NO: 2135) |
| 1003C01 | 897 | 142 - 252 | 164 - 176 | 192 - 198 | 231 - 241 | 1 - 124 | 26 - 34 | 49 - 65 | 98 - 113 | ELGLSIVGATTGALDM (SEQ ID NO: 2174) |
| 1003C02 | 898 | 142 - 252 | 164 - 176 | 192 - 198 | 231 - 241 | 1 - 125 | 26 - 35 | 50 - 66 | 99 - 114 | GDYDILTGYPAECFQI (SEQ ID NO: 2854) |
| 1003C03 | 899 | 142 - 250 | 164 - 174 | 190 - 196 | 229 - 239 | 1 - 125 | 26 - 35 | 50 - 66 | 99 - 114 | GDYDILTGYPAECFQI (SEQ ID NO: 2854) |
| 1003C12 | 900 | 141 - 248 | 162 - 172 | 188 - 194 | 227 - 237 | 1 - 125 | 26 - 35 | 50 - 66 | 99 - 114 | MEYDILTGYYGGYFDY (SEQ ID NO: 2179) |
| 1003D04 | 901 | 140 - 250 | 162 - 174 | 190 - 196 | 229 - 239 | 1 - 123 | 26 - 35 | 50 - 66 | 99 - 112 | RYGDPFYYYYYMNV (SEQ ID NO: 2755) |
| 1003E05 | 902 | 142 - 253 | 164 - 176 | 192 - 198 | 231 - 242 | 1 - 125 | 26 - 35 | 50 - 65 | 99 - 114 | GDYDILTGYPAECFQI (SEQ ID NO: 2854) |
| 1003F01 | 903 | 141 - 251 | 163 - 176 | 192 - 198 | 231 - 240 | 1 - 124 | 26 - 34 | 49 - 65 | 98 - 113 | ELGSSIVGATTGALDM (SEQ ID NO: 2852) |
| 1003F02 | 904 | 140 - 251 | 162 - 175 | 191 - 197 | 230 - 240 | 1 - 123 | 26 - 35 | 50 - 66 | 99 - 112 | RYGDPFYYYYYMNV (SEQ ID NO: 2755) |
| 1003G01 | 905 | 145 - 254 | 168 - 179 | 195 - 201 | 234 - 243 | 1 - 127 | 26 - 35 | 50 - 66 | 99 - 116 | GTGYDILTGYYMGSAFDQ (SEQ ID NO: 2800) |
| 1003G05 | 906 | 144 - 255 | 166 - 179 | 195 - 201 | 234 - 244 | 1 - 127 | 26 - 35 | 50 - 66 | 99 - 116 | GSGYDLLTGYFTGSPLDY (SEQ ID NO: 2766) |
| 1003G06 | 907 | 146 - 256 | 168 - 181 | 197 - 203 | 236 - 245 | 1 - 129 | 26 - 35 | 50 - 66 | 99 - 118 | DRGGNYDILTGYYFHHGVDV (SEQ ID NO: 2914) |
| 1003G11 | 908 | 144 - 251 | 165 - 175 | 191 - 197 | 230 - 240 | 1 - 128 | 26 - 35 | 50 - 66 | 99 - 117 | DAQSYYDILTGYQSYAFDI (SEQ ID NO: 2183) |
| 1003H02 | 909 | 142 - 253 | 164 - 176 | 192 - 198 | 233 - 242 | 1 - 124 | 26 - 35 | 50 - 66 | 99 - 113 | DNYDILTGYSRRFDP (SEQ ID NO: 2942) |
| 1003H05 | 910 | 141 - 251 | 163 - 176 | 192 - 198 | 231 - 240 | 1 - 124 | 26 - 34 | 49 - 65 | 98 - 113 | ELGSSIVGATTGALDM (SEQ ID NO: 2852) |
| 1003H08 | 911 | 142 - 249 | 163 - 173 | 189 - 195 | 228 - 238 | 1 - 126 | 26 - 35 | 50 - 66 | 99 - 115 | DGYYDILTGYSYYGMDV (SEQ ID NO: 2135) |
| 1005A01 | 912 | 141 - 249 | 162 - 172 | 188 - 194 | 227 - 238 | 1 - 125 | 26 - 35 | 50 - 66 | 99 - 114 | SHYDILTGLNYWYFDL (SEQ ID NO: 2166) |
| 1005A02 | 913 | 141 - 248 | 162 - 172 | 188 - 194 | 227 - 237 | 1 - 125 | 26 - 35 | 50 - 66 | 99 - 114 | EGRDILTGVYYYGLDV (SEQ ID NO: 2893) |
| 1005B01 | 914 | 141 - 248 | 162 - 172 | 188 - 194 | 227 - 237 | 1 - 125 | 26 - 35 | 50 - 66 | 99 - 114 | SHYDILTGLNYWYFDL (SEQ ID NO: 2166) |
| 1005B09 | 915 | 137 - 247 | 159 - 172 | 188 - 194 | 227 - 236 | 1 - 121 | 26 - 35 | 50 - 65 | 98 - 110 | TYYDILTGRFFDI (SEQ ID NO: 2866) |
| 1005C01 | 916 | 141 - 248 | 162 - 172 | 188 - 194 | 227 - 237 | 1 - 125 | 26 - 35 | 50 - 66 | 99 - 114 | SHYDILTGLNYWYFDL (SEQ ID NO: 2166) |
| 1005D02 | 917 | 141 - 251 | 163 - 176 | 192 - 198 | 231 - 240 | 1 - 125 | 26 - 35 | 50 - 66 | 99 - 114 | DLRYDILTGYHDAFDI (SEQ ID NO: 2890) |

| | | | | | | | | | |
|---|---|---|---|---|---|---|---|---|---|
| 1005D03 | 918 | 142 - 249 | 165 - 175 | 191 - 197 | 230 - 238 | 1 - 126 | 26 - 35 | 50 - 66 | 99 - 115 | GAYYDILTGYYPYGMDV (SEQ ID NO: 2860) |
| 1005E01 | 919 | 142 - 249 | 165 - 175 | 191 - 197 | 230 - 238 | 1 - 126 | 26 - 35 | 50 - 65 | 99 - 115 | GTYYDILTGYFHYGMDV (SEQ ID NO: 2774) |
| 1005E08 | 920 | 141 - 248 | 162 - 172 | 188 - 194 | 227 - 237 | 1 - 125 | 26 - 35 | 50 - 65 | 99 - 114 | SHYDILTGLNYWYFDL (SEQ ID NO: 2166) |
| 1005F01 | 921 | 142 - 248 | 164 - 174 | 190 - 196 | 229 - 238 | 1 - 124 | 26 - 35 | 50 - 66 | 99 - 113 | EQHDILTGVYYGMDV (SEQ ID NO: 2921) |
| 1005F02 | 922 | 144 - 251 | 167 - 177 | 193 - 199 | 232 - 240 | 1 - 128 | 26 - 35 | 50 - 66 | 99 - 117 | VSPSYDILTGYYLPHAFDV (SEQ ID NO: 2849) |
| 1005F04 | 923 | 137 - 247 | 159 - 172 | 188 - 194 | 227 - 236 | 1 - 121 | 26 - 35 | 50 - 65 | 98 - 110 | TYYDILTGRFFDI (SEQ ID NO: 2866) |
| 1005F08 | 924 | 140 - 247 | 161 - 171 | 187 - 193 | 226 - 236 | 1 - 124 | 26 - 35 | 50 - 66 | 99 - 113 | PSYDILTGYLYYFDY (SEQ ID NO: 2850) |
| 1005G01 | 925 | 141 - 251 | 163 - 176 | 192 - 198 | 231 - 240 | 1 - 125 | 26 - 35 | 50 - 66 | 99 - 114 | DLRYDILTGYHDAFDI (SEQ ID NO: 2890) |
| 1005G08 | 926 | 142 - 249 | 165 - 175 | 191 - 197 | 230 - 238 | 1 - 126 | 26 - 35 | 50 - 66 | 99 - 115 | GAYYDILTGYYPYGMDV (SEQ ID NO: 2860) |
| 1005H02 | 927 | 140 - 247 | 161 - 171 | 187 - 193 | 226 - 236 | 1 - 124 | 26 - 35 | 50 - 66 | 99 - 113 | GQYYDILTGYNWFDP (SEQ ID NO: 2857) |
| 1006B01 | 928 | 139 - 246 | 160 - 170 | 186 - 192 | 225 - 235 | 1 - 123 | 26 - 35 | 50 - 66 | 99 - 112 | SRDLLLFPHYGMDV (SEQ ID NO: 2133) |
| 1006C09 | 929 | 143 - 253 | 165 - 177 | 193 - 199 | 232 - 242 | 1 - 127 | 26 - 35 | 50 - 66 | 99 - 116 | GGYSSGWLRGGPYNWFDP (SEQ ID NO: 2967) |
| 1006D09 | 930 | 141 - 251 | 163 - 176 | 192 - 198 | 231 - 240 | 1 - 125 | 26 - 35 | 50 - 66 | 99 - 114 | GDYDILTGYYIPLRDY (SEQ ID NO: 2792) |
| 1006E01 | 931 | 143 - 253 | 165 - 178 | 194 - 200 | 233 - 242 | 1 - 127 | 26 - 35 | 50 - 68 | 101 - 116 | NLFDVWTLPYYYYMDV (SEQ ID NO: 2965) |
| 1006E07 | 932 | 143 - 250 | 166 - 176 | 192 - 198 | 231 - 239 | 1 - 127 | 26 - 35 | 50 - 66 | 99 - 116 | ADYDILTGYSPLTYGMDV (SEQ ID NO: 2762) |
| 1006F01 | 933 | 140 - 250 | 162 - 175 | 191 - 197 | 230 - 239 | 1 - 124 | 26 - 35 | 50 - 68 | 101 - 113 | MYYDILTGHNFDY (SEQ ID NO: 2879) |
| 1006F02 | 934 | 142 - 253 | 164 - 176 | 192 - 198 | 231 - 242 | 1 - 126 | 26 - 35 | 50 - 66 | 99 - 115 | VSRDILTGNYYYYGMDV (SEQ ID NO: 2817) |
| 1006F07 | 935 | 143 - 253 | 165 - 177 | 193 - 199 | 232 - 242 | 1 - 127 | 26 - 35 | 50 - 66 | 99 - 116 | GGYSSGWLRGGPYNWFDP (SEQ ID NO: 2967) |
| 1006G01 | 936 | 146 - 253 | 169 - 179 | 195 - 201 | 234 - 242 | 1 - 130 | 26 - 35 | 50 - 68 | 101 - 119 | AGGYYDILTGRDYYYGMDV (SEQ ID NO: 2877) |
| 1006G04 | 937 | 132 - 239 | 153 - 163 | 179 - 185 | 218 - 228 | 1 - 116 | 26 - 35 | 50 - 66 | 99 - 105 | RRYALDY (SEQ ID NO: 2920) |
| 1006H01 | 938 | 146 - 253 | 167 - 177 | 193 - 199 | 232 - 242 | 1 - 130 | 26 - 35 | 50 - 65 | 98 - 119 | DRGSYDILTGYYIPPHYYGMDV (SEQ ID NO: 2761) |
| 1006H02 | 939 | 143 - 253 | 165 - 177 | 193 - 199 | 232 - 242 | 1 - 127 | 26 - 35 | 50 - 66 | 99 - 116 | GGYSSGWLRGGPYNWFDP (SEQ ID NO: 2967) |
| 1007A01 | 940 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1007A08 | 941 | 139 - 249 | 161 - 174 | 190 - 196 | 229 - 238 | 1 - 123 | 26 - 35 | 50 - 66 | 99 - 114 | SHYDILTGLNYWYFDY (SEQ ID NO: 2746) |
| 1007A11 | 942 | 140 - 250 | 162 - 175 | 191 - 197 | 230 - 239 | 1 - 124 | 26 - 35 | 50 - 66 | 99 - 113 | ENYDFLTGYYGAFDI (SEQ ID NO: 2772) |
| 1007A12 | 943 | 144 - 251 | 165 - 175 | 191 - 197 | 230 - 240 | 1 - 128 | 26 - 35 | 50 - 68 | 101 - 117 | GIYDILTGYHWDGAFDI (SEQ ID NO: 2892) |
| 1007B04 | 944 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1007C04 | 945 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1007C08 | 946 | 142 - 249 | 163 - 173 | 189 - 195 | 228 - 238 | 1 - 126 | 26 - 35 | 50 - 65 | 98 - 115 | IRLYCYSLTGYYPYGMDD (SEQ ID NO: 2810) |
| 1007C12 | 947 | 140 - 250 | 162 - 175 | 191 - 197 | 230 - 239 | 1 - 124 | 26 - 35 | 50 - 66 | 99 - 113 | TNYDILTGYYQGVDY (SEQ ID NO: 2782) |
| 1007D07 | 948 | 140 - 247 | 161 - 171 | 187 - 193 | 226 - 236 | 1 - 124 | 26 - 35 | 50 - 66 | 99 - 113 | GQYYDILTGYNWFDP (SEQ ID NO: 2857) |
| 1007D08 | 949 | 144 - 251 | 165 - 175 | 191 - 197 | 230 - 240 | 1 - 128 | 26 - 35 | 50 - 68 | 101 - 117 | GIYDILTGYHWDDAFDI (SEQ ID NO: 2872) |
| 1007E03 | 950 | 141 - 248 | 162 - 172 | 188 - 194 | 227 - 237 | 1 - 125 | 26 - 35 | 50 - 66 | 99 - 114 | ATYDPLTGYSFDGFDI (SEQ ID NO: 2153) |
| 1007E10 | 951 | 141 - 251 | 163 - 176 | 192 - 198 | 231 - 240 | 1 - 125 | 26 - 35 | 50 - 66 | 99 - 114 | DFYDILTGYPLGGMDV (SEQ ID NO: 2741) |
| 1007E11 | 952 | 144 - 251 | 165 - 175 | 191 - 197 | 230 - 240 | 1 - 128 | 26 - 35 | 50 - 66 | 99 - 117 | DLPYYDILTGYSLTSGMDV (SEQ ID NO: 2923) |
| 1007F06 | 953 | 141 - 248 | 162 - 172 | 188 - 194 | 227 - 237 | 1 - 125 | 26 - 35 | 50 - 66 | 99 - 114 | ATYDPLTGYSFDGFDI (SEQ ID NO: 2153) |
| 1007F08 | 954 | 143 - 253 | 165 - 178 | 194 - 200 | 233 - 242 | 1 - 127 | 26 - 35 | 50 - 65 | 98 - 116 | GRRYDILTGYYYYHHGMDV (SEQ ID NO: 2811) |
| 1007G07 | 955 | 141 - 251 | 163 - 176 | 192 - 198 | 231 - 240 | 1 - 125 | 26 - 35 | 50 - 66 | 99 - 114 | SHYDILTGLNYWYFDL (SEQ ID NO: 2166) |
| 1007G09 | 956 | 142 - 252 | 164 - 177 | 193 - 199 | 232 - 241 | 1 - 126 | 26 - 35 | 50 - 66 | 99 - 115 | DSGGDILTGYYMPYFDY (SEQ ID NO: 2847) |
| 1007G10 | 957 | 142 - 249 | 163 - 173 | 189 - 195 | 228 - 238 | 1 - 126 | 26 - 35 | 50 - 65 | 98 - 115 | VGLYYDILTGYYPSGMDV (SEQ ID NO: 2805) |
| 1007H07 | 958 | 147 - 257 | 169 - 182 | 198 - 204 | 237 - 246 | 1 - 131 | 26 - 35 | 50 - 68 | 101 - 120 | SQAHYDILTGYYLWSYGMDV (SEQ ID NO: 2875) |
| 1007H11 | 959 | 141 - 248 | 162 - 172 | 188 - 194 | 227 - 237 | 1 - 125 | 26 - 35 | 50 - 66 | 99 - 114 | ESYDILTGYRHYGMDL (SEQ ID NO: 2891) |

| | | | | | | | | | | |
|---|---|---|---|---|---|---|---|---|---|---|
| 1008A02 | 960 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1008A05` | 961 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1008A06 | 962 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1008A07 | 963 | 142 - 249 | 163 - 173 | 189 - 195 | 228 - 238 | 1 - 126 | 26 - 35 | 50 - 66 | 99 - 115 | DREYDLLTGYYLHAFDM (SEQ ID NO: 2960) |
| 1008A12 | 964 | 140 - 250 | 162 - 175 | 191 - 197 | 230 - 239 | 1 - 124 | 26 - 35 | 50 - 66 | 99 - 113 | ENYDFLTGYYGAFDI (SEQ ID NO: 2772) |
| 1008B02 | 965 | 141 - 248 | 162 - 172 | 188 - 194 | 227 - 237 | 1 - 125 | 26 - 35 | 50 - 66 | 99 - 114 | ATYDPLTGYSFDGFDI (SEQ ID NO: 2153) |
| 1008B04 | 966 | 143 - 253 | 165 - 178 | 194 - 200 | 233 - 242 | 1 - 127 | 26 - 35 | 50 - 66 | 99 - 116 | DGSYDILTGYYIDNYMDV (SEQ ID NO: 2154) |
| 1008B05 | 967 | 141 - 248 | 162 - 172 | 188 - 194 | 227 - 237 | 1 - 125 | 26 - 35 | 50 - 66 | 99 - 114 | DHYDILTGLYYYGMDV (SEQ ID NO: 2760) |
| 1008B06 | 968 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1008B07 | 969 | 140 - 247 | 163 - 173 | 189 - 195 | 228 - 236 | 1 - 124 | 24 - 33 | 48 - 64 | 97 - 113 | GRRYDILTGYYKGPLDY (SEQ ID NO: 2902) |
| 1008B10 | 970 | 141 - 248 | 162 - 172 | 188 - 194 | 227 - 237 | 1 - 125 | 26 - 35 | 50 - 66 | 99 - 114 | ATYDNLTGFLPYGMGY (SEQ ID NO: 2947) |
| 1008B11 | 971 | 144 - 254 | 166 - 179 | 195 - 201 | 234 - 243 | 1 - 128 | 26 - 35 | 50 - 66 | 99 - 117 | EGYDILTGYFLDYYHGMDV (SEQ ID NO: 2753) |
| 1008C06 | 972 | 141 - 251 | 163 - 176 | 192 - 198 | 231 - 240 | 1 - 125 | 26 - 35 | 50 - 65 | 99 - 114 | ATYDPLTGYSFDGFDI (SEQ ID NO: 2153) |
| 1008C08 | 973 | 149 - 259 | 171 - 183 | 199 - 205 | 238 - 248 | 1 - 133 | 26 - 35 | 50 - 66 | 99 - 122 | GPRGGPYYDILTGYYLSLSDAFDI (SEQ ID NO: 2729) |
| 1008C09 | 974 | 142 - 249 | 163 - 173 | 189 - 195 | 228 - 238 | 1 - 126 | 25 - 35 | 50 - 66 | 99 - 115 | EYYDILTGYRDPYGMDV (SEQ ID NO: 2973) |
| 1008D01 | 975 | 141 - 251 | 163 - 176 | 192 - 198 | 231 - 240 | 1 - 125 | 25 - 35 | 50 - 66 | 99 - 114 | ATYDPLTGYSFDGFDI (SEQ ID NO: 2153) |
| 1008D02 | 976 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1008D03 | 977 | 144 - 254 | 166 - 179 | 195 - 201 | 234 - 243 | 1 - 128 | 26 - 35 | 50 - 66 | 99 - 117 | EVRNYDLLTRSYLAGPLDN (SEQ ID NO: 2751) |
| 1008D04 | 978 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1008D05 | 979 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1008D06 | 980 | 141 - 248 | 162 - 172 | 188 - 194 | 227 - 237 | 1 - 125 | 26 - 35 | 50 - 66 | 99 - 114 | ATYDPLTGYSFDGFDI (SEQ ID NO: 2153) |
| 1008D07 | 981 | 144 - 254 | 166 - 179 | 195 - 201 | 234 - 243 | 1 - 128 | 26 - 35 | 50 - 66 | 99 - 117 | DRGYYDILTGYYRGHGMDV (SEQ ID NO: 2837) |
| 1008D08 | 982 | 144 - 251 | 165 - 175 | 191 - 197 | 230 - 240 | 1 - 128 | 26 - 35 | 50 - 66 | 99 - 117 | DLPYYDILTGYSLTSGMDV (SEQ ID NO: 2923) |
| 1008D12 | 983 | 144 - 254 | 166 - 179 | 195 - 201 | 234 - 243 | 1 - 128 | 26 - 35 | 50 - 66 | 99 - 117 | EEGFYDILTGYYGPGYFDY (SEQ ID NO: 2974) |
| 1008E01 | 984 | 141 - 248 | 162 - 172 | 188 - 194 | 227 - 237 | 1 - 125 | 26 - 35 | 50 - 66 | 99 - 114 | ATYDPLTGYSFDGFDI (SEQ ID NO: 2153) |
| 1008E02 | 985 | 137 - 247 | 159 - 172 | 188 - 194 | 227 - 236 | 1 - 121 | 20 - 31 | 46 - 63 | 96 - 110 | EGYDILTGYSKFLDY (SEQ ID NO: 2986) |
| 1008E03 | 986 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1008E04 | 987 | 141 - 248 | 162 - 172 | 188 - 194 | 227 - 237 | 1 - 125 | 26 - 35 | 50 - 66 | 99 - 114 | ATYDPLTGYSFDGFDI (SEQ ID NO: 2153) |
| 1008E08 | 988 | 141 - 252 | 163 - 175 | 191 - 197 | 238 - 241 | 1 - 125 | 26 - 35 | 50 - 66 | 99 - 114 | SHYDILTGLNYWYFDL (SEQ ID NO: 2166) |
| 1008E09 | 989 | 143 - 253 | 165 - 178 | 194 - 200 | 233 - 242 | 1 - 127 | 26 - 35 | 50 - 66 | 99 - 116 | ERADYDILTGYYFYDMDV (SEQ ID NO: 2833) |
| 1008E12 | 990 | 141 - 251 | 163 - 176 | 192 - 198 | 231 - 240 | 1 - 125 | 26 - 37 | 52 - 67 | 100 - 114 | FRYDILTSYYYGMDV (SEQ ID NO: 2734) |
| 1008F03 | 991 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1008F06 | 992 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1008F07 | 993 | 143 - 250 | 164 - 174 | 190 - 196 | 229 - 239 | 1 - 127 | 26 - 35 | 50 - 65 | 98 - 116 | GRRYDILTGYYYYHHGMDV (SEQ ID NO: 2811) |
| 1008F08 | 994 | 143 - 253 | 165 - 178 | 194 - 200 | 233 - 242 | 1 - 127 | 26 - 35 | 50 - 66 | 99 - 116 | GHYDILTGYDDYYYGMDV (SEQ ID NO: 2844) |
| 1008F09 | 995 | 133 - 243 | 155 - 168 | 184 - 190 | 223 - 232 | 1 - 117 | 26 - 35 | 50 - 65 | 98 - 106 | HDILTGFDY (SEQ ID NO: 2904) |
| 1008F10 | 996 | 140 - 247 | 161 - 171 | 187 - 193 | 225 - 236 | 1 - 124 | 26 - 35 | 50 - 66 | 99 - 113 | SGYDILTGYLYGMDV (SEQ ID NO: 2934) |
| 1008F11 | 997 | 144 - 251 | 165 - 175 | 191 - 197 | 230 - 240 | 1 - 128 | 26 - 35 | 50 - 68 | 101 - 117 | APYDILTGYSDYYGMDV (SEQ ID NO: 2968) |
| 1008G02 | 998 | 141 - 251 | 163 - 175 | 192 - 198 | 231 - 240 | 1 - 125 | 26 - 35 | 50 - 66 | 99 - 114 | ATYDPLTGYSFDGFDI (SEQ ID NO: 2153) |
| 1008G03 | 999 | 140 - 247 | 161 - 171 | 187 - 193 | 226 - 236 | 1 - 124 | 26 - 35 | 50 - 66 | 99 - 113 | GDYDPLTGYSFGYDY (SEQ ID NO: 2941) |
| 1008G04 | 1000 | 143 - 253 | 165 - 178 | 194 - 200 | 233 - 242 | 1 - 127 | 26 - 35. | 50 - 65 | 98 - 116 | EGSYDILTGYYVGVGRMDV (SEQ ID NO: 2171) |
| 1008G05 | 1001 | 144 - 254 | 166 - 179 | 195 - 201 | 234 - 243 | 1 - 128 | 26 - 35 | 50 - 66 | 99 - 117 | DGYYDILTGGFYYYYGMDV (SEQ ID NO: 2899) |

| | | | | | | | | | | |
|---|---|---|---|---|---|---|---|---|---|---|
| 1008G11 | 1002 | 136-246 | 158-171 | 187-193 | 226-235 | 1-120 | 26-35 | 50-66 | 99-109 | AYYDILTGLDY (SEQ ID NO: 2966) |
| 1008G12 | 1003 | 143-253 | 165-178 | 194-200 | 233-242 | 1-127 | 26-35 | 50-66 | 99-116 | DQQYDILTGYYIHYGMDV (SEQ ID NO: 2964) |
| 1008H02 | 1004 | 141-248 | 164-174 | 190-196 | 229-237 | 1-125 | 26-35 | 50-66 | 99-114 | DQVDLLLMDHNYYMDV (SEQ ID NO: 2918) |
| 1008H03 | 1005 | 141-251 | 163-176 | 192-198 | 231-240 | 1-125 | 26-35 | 50-66 | 99-114 | ATYDPLTGYSFDGFDI (SEQ ID NO: 2153) |
| 1008H06 | 1006 | 143-253 | 165-178 | 194-200 | 233-242 | 1-127 | 26-35 | 50-65 | 98-116 | EGSYDILTGYYVGVGRMDV (SEQ ID NO: 2171) |
| 1008H09 | 1007 | 143-253 | 165-178 | 194-200 | 233-242 | 1-127 | 26-35 | 50-66 | 99-116 | DQQYDILTGYYIHYGMDV (SEQ ID NO: 2964) |
| 1008H11 | 1008 | 141-248 | 164-174 | 190-196 | 229-237 | 1-125 | 26-35 | 50-66 | 99-114 | TKYDILTGYYYYYMDV (SEQ ID NO: 2856) |
| 1012B03 | 1009 | 141-249 | 163-175 | 191-197 | 230-238 | 1-124 | 26-34 | 49-65 | 98-113 | ELGLSIVGATTGALDM (SEQ ID NO: 2174) |
| 1012B06 | 1010 | 141-251 | 163-176 | 192-198 | 231-240 | 1-124 | 26-34 | 49-65 | 98-113 | ELGLSIVGATTGALDM (SEQ ID NO: 2174) |
| 1012B10 | 1011 | 141-251 | 163-175 | 191-197 | 230-240 | 1-124 | 26-34 | 49-65 | 98-113 | ELGLSIVGATTGALDM (SEQ ID NO: 2174) |
| 1012C03 | 1012 | 143-255 | 165-178 | 194-200 | 233-244 | 1-126 | 26-35 | 50-66 | 99-115 | TDRFGAKDVTSRWGMDV (SEQ ID NO: 2814) |
| 1012C06 | 1013 | 141-251 | 163-176 | 192-198 | 231-240 | 1-124 | 26-34 | 49-65 | 98-113 | ELGLSIVGATTGALDM (SEQ ID NO: 2174) |
| 1012C09 | 1014 | 142-250 | 164-174 | 190-196 | 229-239 | 1-124 | 26-34 | 49-65 | 98-113 | ELGLSIVGATTGALDM (SEQ ID NO: 2174) |
| 1012D12 | 1015 | 146-256 | 168-180 | 196-202 | 235-245 | 1-129 | 26-35 | 50-66 | 99-118 | DRGGNYDILTGYYFHHGVDV (SEQ ID NO: 2914) |
| 1012E07 | 1016 | 142-252 | 164-176 | 192-198 | 231-241 | 1-124 | 26-34 | 49-65 | 98-113 | ELGLSIVGATTGALDM (SEQ ID NO: 2174) |
| 1012E08 | 1017 | 140-250 | 162-174 | 190-196 | 229-239 | 1-123 | 26-35 | 50-66 | 99-112 | RYGDPFYYYYYMNV (SEQ ID NO: 2755) |
| 1012E09 | 1018 | 141-247 | 163-173 | 189-195 | 228-236 | 1-124 | 26-34 | 49-65 | 98-113 | ELGLSIVGATTGALDM (SEQ ID NO: 2174) |
| 1012F05 | 1019 | 141-249 | 163-173 | 189-195 | 228-238 | 1-124 | 26-34 | 49-65 | 98-113 | ELGLSIVGATTGALDM (SEQ ID NO: 2174) |
| 1012F12 | 1020 | 142-251 | 164-176 | 192-198 | 231-240 | 1-124 | 26-34 | 49-65 | 98-113 | ELGLSIVGATTGALDM (SEQ ID NO: 2174) |
| 1012G03 | 1021 | 142-252 | 164-176 | 192-198 | 231-241 | 1-124 | 26-34 | 49-65 | 98-113 | ELGLSIVGATTGALDM (SEQ ID NO: 2174) |
| 1012G05 | 1022 | 141-250 | 163-173 | 189-195 | 228-239 | 1-123 | 26-35 | 50-66 | 99-112 | RYGDPFYYYYYMNV (SEQ ID NO: 2755) |
| 1012G10 | 1023 | 140-251 | 162-175 | 191-197 | 230-240 | 1-123 | 26-35 | 50-66 | 99-112 | RYGDPFYYYYYMNV (SEQ ID NO: 2755) |
| 1012H09 | 1024 | 141-249 | 163-173 | 189-195 | 228-238 | 1-124 | 26-34 | 49-65 | 98-113 | ELGLSIVGATTGALDM (SEQ ID NO: 2174) |
| 1013A10 | 1025 | 148-259 | 170-182 | 198-204 | 237-248 | 1-131 | 26-35 | 50-66 | 99-120 | SSPPKWYDALTGHSSYHSAMDV (SEQ ID NO: 2159) |
| 1013A12 | 1026 | 149-256 | 171-181 | 197-203 | 236-245 | 1-131 | 26-35 | 50-66 | 99-120 | SSPPKWYDALTGHSSYHSAMDV (SEQ ID NO: 2159) |
| 1013B04 | 1027 | 149-256 | 172-182 | 198-204 | 237-245 | 1-131 | 26-35 | 50-66 | 99-120 | SSPPKWYDALTGDSSYHSAMDV (SEQ ID NO: 2165) |
| 1013B09 | 1028 | 149-257 | 171-181 | 197-203 | 236-246 | 1-131 | 26-35 | 50-66 | 99-120 | SSPPKWYDALTGHSSYHSAMDV (SEQ ID NO: 2159) |
| 1013C02 | 1029 | 148-258 | 170-182 | 198-204 | 237-247 | 1-131 | 26-35 | 50-66 | 99-120 | SSPPKWYDALTGDSSYRSAMDV (SEQ ID NO: 2818) |
| 1013C04 | 1030 | 139-249 | 161-173 | 189-195 | 228-238 | 1-121 | 26-35 | 50-66 | 99-110 | GYDSSAFRAFDI (SEQ ID NO: 2136) |
| 1013D02 | 1031 | 138-248 | 160-173 | 189-195 | 228-237 | 1-121 | 26-35 | 50-66 | 99-110 | GYDSSAFRAFDI (SEQ ID NO: 2136) |
| 1013D03 | 1032 | 148-259 | 170-183 | 199-205 | 238-248 | 1-131 | 26-35 | 50-66 | 99-120 | SSPPKWYDALTGDSSYHSAMDV (SEQ ID NO: 2165) |
| 1013D10 | 1033 | 146-257 | 168-181 | 197-203 | 236-246 | 1-129 | 26-35 | 50-66 | 99-118 | GLRHVTLFGTGTRGHFYMDV (SEQ ID NO: 2789) |
| 1013E02 | 1034 | 148-259 | 170-183 | 199-205 | 238-248 | 1-131 | 26-35 | 50-66 | 99-120 | GREDTDKVKPWDRYYHYYYMDV (SEQ ID NO: 2809) |
| 1013E05 | 1035 | 139-249 | 162-173 | 189-195 | 228-238 | 1-121 | 26-35 | 50-66 | 99-110 | GYDSSAFRAFDI (SEQ ID NO: 2136) |
| 1013E09 | 1036 | 148-260 | 170-183 | 199-205 | 238-249 | 1-131 | 26-35 | 50-66 | 99-120 | SSPPKWYDALTGDSSYHSAMDV (SEQ ID NO: 2165) |
| 1013F03 | 1037 | 138-248 | 160-172 | 188-194 | 227-237 | 1-121 | 26-35 | 50-66 | 99-110 | GYDSSAFRAFDI (SEQ ID NO: 2136) |
| 1013F04 | 1038 | 148-258 | 170-182 | 198-204 | 237-247 | 1-131 | 26-35 | 50-66 | 99-120 | SSPPKWYDALTGHSSYHSAMDV (SEQ ID NO: 2159) |
| 1013F07 | 1039 | 147-260 | 170-185 | 201-207 | 240-249 | 1-129 | 26-35 | 50-66 | 99-118 | AATTSQKHNKYAYYFYGMDV (SEQ ID NO: 2131) |
| 1013F09 | 1040 | 138-248 | 160-172 | 188-194 | 227-237 | 1-121 | 26-35 | 50-66 | 99-110 | GYDSSAFRAFDI (SEQ ID NO: 2136) |
| 1013F10 | 1041 | 148-259 | 170-183 | 199-206 | 238-248 | 1-131 | 26-35 | 50-66 | 99-120 | SSPPKWYDALTGHSSYHSAMDV (SEQ ID NO: 2159) |
| 1013H04 | 1042 | 148-258 | 170-182 | 198-204 | 237-247 | 1-131 | 26-35 | 50-66 | 99-120 | SSPPKWYDALTGHSSYHSAMDV (SEQ ID NO: 2159) |
| 1013H07 | 1043 | 148-259 | 170-183 | 199-205 | 238-248 | 1-131 | 26-35 | 50-66 | 99-120 | GREDTDKVKPWDRYYHYYYMDV (SEQ ID NO: 2809) |

| | | | | | | | | | | |
|---|---|---|---|---|---|---|---|---|---|---|
| 1014A12 | 1044 | 143 - 253 | 165 - 178 | 194 - 200 | 233 - 242 | 1 - 127 | 24 - 33 | 48 - 64 | 97 - 116 | EGGNYDILTGYYIGNGAFDI (SEQ ID NO: 2158) |
| 1014C06 | 1045 | 142 - 254 | 164 - 177 | 193 - 200 | 233 - 243 | 1 - 125 | 26 - 35 | 50 - 66 | 99 - 114 | GDYDILTGYPAECFQI (SEQ ID NO: 2854) |
| 1014C10 | 1046 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1014C12 | 1047 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1014E06 | 1048 | 142 - 252 | 164 - 176 | 192 - 198 | 231 - 241 | 1 - 124 | 26 - 34 | 49 - 65 | 98 - 113 | ELGLSIVGATTGALDM (SEQ ID NO: 2174) |
| 1014F02 | 1049 | 143 - 251 | 166 - 176 | 192 - 198 | 231 - 240 | 1 - 125 | 26 - 37 | 52 - 67 | 100 - 114 | AGYDLLTGYPFYFDS (SEQ ID NO: 2757) |
| 1016A08 | 1050 | 144 - 251 | 165 - 175 | 191 - 197 | 230 - 240 | 1 - 128 | 26 - 35 | 50 - 66 | 99 - 117 | EVRNYDLLTRSYLAGPLDN (SEQ ID NO: 2751) |
| 1016A09 | 1051 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1016C02 | 1052 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1016C03 | 1053 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1016C05 | 1054 | 148 - 255 | 169 - 179 | 195 - 201 | 234 - 244 | 1 - 132 | 26 - 35 | 50 - 66 | 99 - 121 | VQMDSEYYDLLTGINVGPYYFDY (SEQ ID NO: 2132) |
| 1016C09 | 1055 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1016C11 | 1056 | 148 - 255 | 169 - 179 | 195 - 201 | 234 - 244 | 1 - 132 | 26 - 35 | 50 - 66 | 99 - 121 | VQMDSEYYDLLTGINVGPYYFDY (SEQ ID NO: 2132) |
| 1016D10 | 1057 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1016D11 | 1058 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1016E03 | 1059 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1016E04 | 1060 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1016F03 | 1061 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1016F11 | 1062 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1016G01 | 1063 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1016G06 | 1064 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1016G12 | 1065 | 148 - 255 | 169 - 179 | 195 - 201 | 234 - 244 | 1 - 132 | 26 - 35 | 50 - 66 | 99 - 121 | VQMDSEYYDLLTGINVGPYYFDY (SEQ ID NO: 2132) |
| 1016H10 | 1066 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1017A06 | 1067 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1017A07 | 1068 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1017A11 | 1069 | 140 - 253 | 162 - 175 | 191 - 197 | 233 - 242 | 1 - 124 | 25 - 34 | 49 - 65 | 98 - 113 | ATYDPLTGYSFDGLDI (SEQ ID NO: 2157) |
| 1017B12 | 1070 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1017G03 | 1071 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1017G07 | 1072 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1017H01 | 1073 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1018A02 | 1074 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1018A04 | 1075 | 144 - 254 | 166 - 179 | 195 - 201 | 234 - 243 | 1 - 128 | 26 - 35 | 50 - 66 | 99 - 117 | EGSYDILTGYYVGVGRMDV (SEQ ID NO: 2171) |
| 1018A05 | 1076 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1018A11 | 1077 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1018B02 | 1078 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1018B08 | 1079 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1018C04 | 1080 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1018D02 | 1081 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1018E06 | 1082 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1018E08 | 1083 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1018F04 | 1084 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1018G06 | 1085 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |

| | | | | | | | | | | |
|---|---|---|---|---|---|---|---|---|---|---|
| 1018H07 | 1086 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1019E05 | 1087 | 144 - 254 | 166 - 179 | 195 - 201 | 234 - 243 | 1 - 128 | 26 - 35 | 50 - 66 | 99 - 117 | ERHYYDILTGYQTGYGMDV (SEQ ID NO: 2784) |
| 1019F06 | 1088 | 144 - 254 | 166 - 179 | 195 - 201 | 234 - 243 | 1 - 128 | 26 - 35 | 50 - 66 | 99 - 117 | ERHYYDILTGYQTGYGMDV (SEQ ID NO: 2784) |
| 1019G12 | 1089 | 143 - 253 | 165 - 178 | 194 - 200 | 233 - 242 | 1 - 127 | 24 - 33 | 48 - 64 | 97 - 116 | EGGNYDILTGYYIGNGAFDI (SEQ ID NO: 2158) |
| 1020D01 | 1090 | 137 - 247 | 159 - 171 | 187 - 193 | 226 - 235 | 1 - 121 | 26 - 35 | 50 - 66 | 99 - 110 | DRETKVGYGMDV (SEQ ID NO: 2945) |
| 1020D05 | 1091 | 143 - 253 | 165 - 178 | 194 - 200 | 233 - 242 | 1 - 127 | 24 - 33 | 48 - 64 | 97 - 116 | EGGNYDILTGYYIGNGAFDI (SEQ ID NO: 2158) |
| 1020E10 | 1092 | 143 - 253 | 165 - 178 | 194 - 200 | 233 - 242 | 1 - 127 | 24 - 33 | 48 - 64 | 97 - 116 | EGGNYDILTGYYIGNGAFDI (SEQ ID NO: 2158) |
| 1020G12 | 1093 | 143 - 253 | 165 - 178 | 194 - 200 | 233 - 242 | 1 - 127 | 24 - 33 | 48 - 64 | 97 - 116 | EGGNYDILTGYYIGNGAFDI (SEQ ID NO: 2158) |
| 1020H06 | 1094 | 143 - 253 | 165 - 178 | 194 - 200 | 233 - 242 | 1 - 127 | 24 - 33 | 48 - 64 | 97 - 116 | EGGNYHILTGYYIGNGAFDI (SEQ ID NO: 2896) |
| 1020H10 | 1095 | 143 - 253 | 165 - 178 | 194 - 200 | 233 - 242 | 1 - 127 | 24 - 33 | 48 - 64 | 97 - 116 | EGENYDILTGYYIGNGAFDI (SEQ ID NO: 2903) |
| 1021A11 | 1096 | 143 - 253 | 165 - 178 | 194 - 200 | 233 - 242 | 1 - 127 | 24 - 33 | 48 - 64 | 97 - 116 | EGGNYDILTGYYIGNGAFDI (SEQ ID NO: 2158) |
| 1021B01 | 1097 | 143 - 253 | 165 - 178 | 194 - 200 | 233 - 242 | 1 - 127 | 24 - 33 | 48 - 64 | 97 - 116 | EGGNYDILTGYYIGNGAFDI (SEQ ID NO: 2158) |
| 1021C11 | 1098 | 143 - 253 | 165 - 178 | 194 - 200 | 233 - 242 | 1 - 127 | 24 - 33 | 48 - 64 | 97 - 116 | EGGNYDILTGYYIGNGAFDI (SEQ ID NO: 2158) |
| 1021D12 | 1099 | 137 - 247 | 159 - 171 | 187 - 193 | 226 - 236 | 1 - 121 | 26 - 35 | 50 - 65 | 99 - 110 | DRETKVGYGMDV (SEQ ID NO: 2945) |
| 1021E10 | 1100 | 143 - 253 | 165 - 178 | 194 - 200 | 233 - 242 | 1 - 127 | 24 - 33 | 48 - 64 | 97 - 116 | EGGNYDILTGYYIGNGAFDI (SEQ ID NO: 2158) |
| 1021G02 | 1101 | 143 - 253 | 165 - 178 | 194 - 200 | 233 - 242 | 1 - 127 | 24 - 33 | 48 - 64 | 97 - 116 | EGGNYDILTGYYIGNGAFDI (SEQ ID NO: 2158) |
| 1022A08 | 1102 | 142 - 249 | 163 - 173 | 189 - 195 | 228 - 238 | 1 - 126 | 26 - 35 | 50 - 65 | 99 - 115 | DGYYDILTGYSYYGMDV (SEQ ID NO: 2135) |
| 1022B01 | 1103 | 141 - 251 | 163 - 176 | 192 - 198 | 231 - 240 | 1 - 125 | 26 - 35 | 50 - 65 | 99 - 114 | ATYDPLTGYSFDGFDI (SEQ ID NO: 2153) |
| 1022B10 | 1104 | 141 - 248 | 164 - 174 | 190 - 196 | 229 - 237 | 1 - 125 | 26 - 35 | 50 - 65 | 99 - 114 | MEYDILTGYYGGYFDY (SEQ ID NO: 2179) |
| 1022C02 | 1105 | 142 - 249 | 163 - 173 | 189 - 195 | 228 - 238 | 1 - 126 | 26 - 35 | 50 - 65 | 99 - 115 | DGYYDILTGYSYYGMDV (SEQ ID NO: 2135) |
| 1022C04 | 1106 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1022C08 | 1107 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1022D06 | 1108 | 142 - 249 | 163 - 173 | 189 - 195 | 228 - 238 | 1 - 126 | 26 - 35 | 50 - 66 | 99 - 115 | DGYYDILTGYSYYGMDV (SEQ ID NO: 2135) |
| 1022E08 | 1109 | 142 - 249 | 163 - 173 | 189 - 195 | 228 - 238 | 1 - 126 | 26 - 35 | 50 - 66 | 99 - 115 | ASYYDILTGYYKGAFDI (SEQ ID NO: 2855) |
| 1022F01 | 1110 | 142 - 249 | 163 - 173 | 189 - 195 | 228 - 238 | 1 - 126 | 26 - 35 | 50 - 66 | 99 - 115 | DGYYDILTGYSYYGMDV (SEQ ID NO: 2135) |
| 1022F04 | 1111 | 142 - 249 | 163 - 173 | 189 - 195 | 228 - 238 | 1 - 126 | 26 - 35 | 50 - 66 | 99 - 115 | DGYYDILTGYSYYGMDV (SEQ ID NO: 2135) |
| 1022F12 | 1112 | 140 - 247 | 161 - 171 | 187 - 193 | 226 - 236 | 1 - 124 | 26 - 35 | 50 - 66 | 99 - 113 | GDYDILTGYYYIDV (SEQ ID NO: 2859) |
| 1022G11 | 1113 | 142 - 249 | 163 - 173 | 189 - 195 | 228 - 238 | 1 - 126 | 26 - 35 | 50 - 66 | 99 - 115 | DGYYDILTGYSYYGMDV (SEQ ID NO: 2135) |
| 1023D01 | 1114 | 141 - 251 | 163 - 176 | 192 - 198 | 231 - 240 | 1 - 125 | 26 - 35 | 50 - 66 | 99 - 114 | SHYDILTGLNYWYFDL (SEQ ID NO: 2166) |
| 1023D04 | 1115 | 142 - 249 | 163 - 173 | 189 - 195 | 228 - 238 | 1 - 126 | 26 - 35 | 50 - 66 | 99 - 115 | DGYYDILTGYSYYGMDV (SEQ ID NO: 2135) |
| 1024B04 | 1116 | 140 - 247 | 161 - 171 | 187 - 193 | 226 - 236 | 1 - 124 | 26 - 35 | 50 - 66 | 99 - 113 | VYYDILTGYNLFFDY (SEQ ID NO: 2177) |
| 1024D01 | 1117 | 142 - 249 | 163 - 173 | 189 - 195 | 228 - 238 | 1 - 126 | 26 - 35 | 50 - 66 | 99 - 115 | DGYYDILTGYSYYGMDV (SEQ ID NO: 2135) |
| 1024F06 | 1118 | 142 - 249 | 163 - 173 | 189 - 195 | 228 - 238 | 1 - 126 | 26 - 35 | 50 - 66 | 99 - 115 | DGYYDILTGYSYYGMDV (SEQ ID NO: 2135) |
| 1024H01 | 1119 | 142 - 249 | 163 - 173 | 189 - 195 | 228 - 238 | 1 - 126 | 26 - 35 | 50 - 66 | 99 - 115 | DGYYDILTGYSYYGMDV (SEQ ID NO: 2135) |
| 1024H07 | 1120 | 142 - 249 | 163 - 173 | 189 - 195 | 228 - 238 | 1 - 126 | 26 - 35 | 50 - 66 | 99 - 115 | DGYYDILTGYSYYGMDV (SEQ ID NO: 2135) |
| 1025A01 | 1121 | 141 - 251 | 163 - 176 | 192 - 198 | 231 - 240 | 1 - 124 | 26 - 34 | 49 - 65 | 98 - 113 | ELGSSIVGATTGALDM (SEQ ID NO: 2852) |
| 1025A04 | 1122 | 141 - 251 | 163 - 175 | 191 - 197 | 230 - 240 | 1 - 124 | 26 - 34 | 49 - 65 | 98 - 113 | ELGLSIVGATTGALDM (SEQ ID NO: 2174) |
| 1025A07 | 1123 | 141 - 249 | 163 - 173 | 189 - 195 | 228 - 238 | 1 - 124 | 26 - 34 | 49 - 65 | 98 - 113 | ELGLSIVGATTGALDM (SEQ ID NO: 2174) |
| 1025B01 | 1124 | 134 - 244 | 156 - 168 | 184 - 190 | 223 - 233 | 1 - 117 | 26 - 35 | 50 - 66 | 99 - 106 | DQGRYLDL (SEQ ID NO: 2175) |
| 1025B10 | 1125 | 142 - 253 | 164 - 176 | 192 - 198 | 233 - 242 | 1 - 124 | 26 - 35 | 50 - 66 | 99 - 113 | DNYDILTGYSRRFDP (SEQ ID NO: 2942) |
| 1025B12 | 1126 | 141 - 251 | 163 - 176 | 192 - 198 | 231 - 240 | 1 - 124 | 26 - 34 | 49 - 65 | 98 - 113 | ELGSSIVGATTGALDM (SEQ ID NO: 2852) |
| 1025C07 | 1127 | 141 - 251 | 163 - 176 | 192 - 198 | 231 - 240 | 1 - 124 | 26 - 34 | 49 - 65 | 98 - 113 | ELGSSIVGATTGALDM (SEQ ID NO: 2852) |

| | | | | | | | | | | |
|---|---|---|---|---|---|---|---|---|---|---|
| 1025D11 | 1128 | 142 - 252 | 164 - 176 | 192 - 198 | 231 - 241 | 1 - 124 | 26 - 34 | 49 - 65 | 98 - 113 | ELGLSIVGATTGALDM (SEQ ID NO: 2174) |
| 1025E04 | 1129 | 142 - 252 | 164 - 176 | 192 - 198 | 231 - 241 | 1 - 126 | 26 - 35 | 50 - 66 | 99 - 115 | FLGITAVRGAKTDAFGI (SEQ ID NO: 2929) |
| 1025E05 | 1130 | 141 - 251 | 163 - 175 | 191 - 197 | 230 - 240 | 1 - 124 | 26 - 34 | 49 - 65 | 98 - 113 | ELGLSIVGATTGALDM (SEQ ID NO: 2174) |
| 1025E07 | 1131 | 142 - 252 | 164 - 176 | 192 - 198 | 231 - 241 | 1 - 124 | 26 - 34 | 49 - 65 | 98 - 113 | ELGLSIVGATTGALDM (SEQ ID NO: 2174) |
| 1025E10 | 1132 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1025F01 | 1133 | 140 - 251 | 162 - 175 | 191 - 197 | 230 - 240 | 1 - 123 | 26 - 35 | 50 - 66 | 99 - 112 | RYGDPFYYYYYMNV (SEQ ID NO: 2755) |
| 1025F08 | 1134 | 138 - 248 | 160 - 172 | 188 - 194 | 227 - 237 | 1 - 121 | 26 - 35 | 50 - 66 | 99 - 110 | GGSSQNFYGMDV (SEQ ID NO: 2884) |
| 1025G03 | 1135 | 142 - 252 | 164 - 176 | 192 - 198 | 231 - 241 | 1 - 124 | 26 - 34 | 49 - 65 | 98 - 113 | ELGLSIVGATTGALDM (SEQ ID NO: 2174) |
| 1025G08 | 1136 | 141 - 254 | 163 - 176 | 192 - 198 | 231 - 243 | 1 - 124 | 26 - 34 | 49 - 65 | 98 - 113 | ELGLSIVGATTGALDM (SEQ ID NO: 2174) |
| 1025H02 | 1137 | 145 - 255 | 167 - 179 | 195 - 201 | 234 - 244 | 1 - 128 | 26 - 35 | 50 - 65 | 98 - 117 | AGSGFHDILTGYYKGGYFDY (SEQ ID NO: 2961) |
| 1026A01 | 1138 | 143 - 249 | 165 - 175 | 191 - 197 | 230 - 238 | 1 - 125 | 26 - 35 | 50 - 66 | 99 - 114 | GDYDILTGYPAECFQI (SEQ ID NO: 2854) |
| 1026B01 | 1139 | 144 - 254 | 166 - 178 | 194 - 200 | 233 - 243 | 1 - 127 | 26 - 35 | 50 - 66 | 99 - 116 | GSVYDILTGTYYKSGMGV (SEQ ID NO: 2733) |
| 1026B06 | 1140 | 141 - 251 | 163 - 176 | 192 - 198 | 231 - 240 | 1 - 124 | 26 - 34 | 49 - 65 | 98 - 113 | ELGSSIVGATTGALDM (SEQ ID NO: 2852) |
| 1026C06 | 1141 | 141 - 251 | 163 - 176 | 192 - 198 | 231 - 240 | 1 - 124 | 26 - 34 | 49 - 65 | 98 - 113 | ELGSSIVGATTGALDM (SEQ ID NO: 2852) |
| 1026C10 | 1142 | 139 - 249 | 161 - 174 | 190 - 196 | 229 - 238 | 1 - 122 | 26 - 34 | 49 - 65 | 98 - 111 | RYGDPFYYYYYMNV (SEQ ID NO: 2755) |
| 1026C11 | 1143 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1026D09 | 1144 | 140 - 252 | 162 - 175 | 191 - 197 | 230 - 241 | 1 - 123 | 26 - 35 | 50 - 66 | 99 - 112 | RYGDPFYYYYYMNV (SEQ ID NO: 2755) |
| 1026E04 | 1145 | 142 - 252 | 164 - 176 | 192 - 198 | 231 - 241 | 1 - 124 | 26 - 34 | 49 - 65 | 98 - 113 | ELGLSIVGATTGALDM (SEQ ID NO: 2174) |
| 1026E06 | 1146 | 141 - 251 | 163 - 175 | 191 - 197 | 230 - 240 | 1 - 124 | 26 - 35 | 50 - 66 | 99 - 113 | GYDDILTGYIMALDY (SEQ ID NO: 2821) |
| 1026E09 | 1147 | 141 - 251 | 163 - 176 | 192 - 198 | 231 - 240 | 1 - 124 | 26 - 34 | 49 - 65 | 98 - 113 | ELGSSIVGATTGALDM (SEQ ID NO: 2852) |
| 1026F01 | 1148 | 141 - 251 | 163 - 176 | 192 - 198 | 231 - 240 | 1 - 124 | 26 - 34 | 49 - 65 | 98 - 113 | ELGSSIVGATTGALDM (SEQ ID NO: 2852) |
| 1026F09 | 1149 | 141 - 251 | 163 - 176 | 192 - 198 | 231 - 240 | 1 - 124 | 26 - 34 | 49 - 65 | 98 - 113 | ELGSSIVGATTGALDM (SEQ ID NO: 2852) |
| 1026F12 | 1150 | 141 - 256 | 163 - 176 | 192 - 202 | 237 - 245 | 1 - 124 | 26 - 34 | 49 - 65 | 98 - 113 | ELGSSIVGATTGALDM (SEQ ID NO: 2852) |
| 1026G08 | 1151 | 141 - 251 | 163 - 176 | 192 - 198 | 231 - 240 | 1 - 124 | 26 - 34 | 49 - 65 | 98 - 113 | ELGSSIVGATTGALDM (SEQ ID NO: 2852) |
| 1026G10 | 1152 | 141 - 251 | 163 - 176 | 192 - 198 | 231 - 240 | 1 - 124 | 26 - 34 | 49 - 65 | 98 - 113 | ELGSSIVGATTGALDM (SEQ ID NO: 2852) |
| 1026G11 | 1153 | 144 - 255 | 166 - 179 | 195 - 201 | 234 - 244 | 1 - 127 | 26 - 35 | 50 - 66 | 99 - 116 | GTGYDILTGYYMGSAFDQ (SEQ ID NO: 2800) |
| 1026H02 | 1154 | 140 - 251 | 162 - 175 | 191 - 197 | 230 - 240 | 1 - 123 | 26 - 35 | 50 - 66 | 99 - 112 | RYGDPFYYYYYMNV (SEQ ID NO: 2755) |
| 1026H06 | 1155 | 141 - 251 | 163 - 175 | 191 - 197 | 230 - 240 | 1 - 124 | 26 - 34 | 49 - 65 | 98 - 113 | ELGLSIVGATTGALDM (SEQ ID NO: 2174) |
| 1026H10 | 1156 | 145 - 255 | 167 - 179 | 195 - 201 | 234 - 244 | 1 - 128 | 26 - 35 | 50 - 66 | 99 - 117 | GGEYDILTGYYFGLGVYDY (SEQ ID NO: 2170) |
| 1027A09 | 1157 | 141 - 251 | 163 - 176 | 192 - 198 | 231 - 240 | 1 - 124 | 25 - 34 | 49 - 65 | 98 - 113 | ELGSSIVGATTGALDM (SEQ ID NO: 2852) |
| 1027B02 | 1158 | 140 - 250 | 162 - 174 | 190 - 196 | 229 - 239 | 1 - 123 | 26 - 35 | 50 - 66 | 99 - 112 | RYGDPFYYYYYMNV (SEQ ID NO: 2755) |
| 1027B05 | 1159 | 141 - 250 | 163 - 176 | 192 - 198 | 230 - 239 | 1 - 124 | 25 - 34 | 49 - 65 | 98 - 113 | ELGSSIVGATTGALDM (SEQ ID NO: 2852) |
| 1027C08 | 1160 | 139 - 249 | 161 - 174 | 190 - 196 | 229 - 238 | 1 - 122 | 26 - 34 | 49 - 63 | 96 - 111 | ELGSSIVGATTGALDM (SEQ ID NO: 2852) |
| 1027D02 | 1161 | 142 - 250 | 164 - 174 | 190 - 196 | 229 - 239 | 1 - 125 | 26 - 35 | 50 - 66 | 99 - 114 | DPFGAVPGYYYYAMDV (SEQ ID NO: 2826) |
| 1027E03 | 1162 | 141 - 251 | 163 - 176 | 192 - 198 | 231 - 240 | 1 - 124 | 26 - 34 | 49 - 65 | 98 - 113 | ELGSSIVGATTGALDM (SEQ ID NO: 2852) |
| 1027E05 | 1163 | 142 - 252 | 164 - 176 | 192 - 198 | 231 - 241 | 1 - 124 | 26 - 34 | 49 - 65 | 98 - 113 | ELGLSIVGATTGALDM (SEQ ID NO: 2174) |
| 1027F04 | 1164 | 145 - 252 | 167 - 176 | 192 - 198 | 231 - 241 | 1 - 128 | 26 - 35 | 50 - 66 | 99 - 117 | GPWYDPLFPPSGRHYGLDV (SEQ ID NO: 2793) |
| 1027F05 | 1165 | 141 - 254 | 163 - 176 | 192 - 198 | 231 - 243 | 1 - 124 | 26 - 34 | 49 - 65 | 98 - 113 | ELGLSIVGATTGALDM (SEQ ID NO: 2174) |
| 1027F11 | 1166 | 141 - 251 | 163 - 176 | 192 - 198 | 231 - 240 | 1 - 124 | 26 - 34 | 49 - 65 | 98 - 113 | ELGSSIVGATTGALDM (SEQ ID NO: 2852) |
| 1027G06 | 1167 | 142 - 253 | 164 - 176 | 192 - 198 | 233 - 242 | 1 - 124 | 26 - 35 | 50 - 66 | 99 - 113 | DNYDILTGYSRRFDP (SEQ ID NO: 2942) |
| 1027G07 | 1168 | 142 - 250 | 164 - 174 | 190 - 196 | 229 - 239 | 1 - 124 | 26 - 34 | 49 - 65 | 98 - 113 | ELGLSIVGATTGALDM (SEQ ID NO: 2174) |
| 1027H03 | 1169 | 142 - 252 | 164 - 176 | 192 - 198 | 231 - 241 | 1 - 125 | 26 - 35 | 50 - 66 | 99 - 114 | GDYDILTGYPAECFQI (SEQ ID NO: 2854) |

| | | | | | | | | | | |
|---|---|---|---|---|---|---|---|---|---|---|
| 1028A04 | 1170 | 143 - 250 | 164 - 174 | 190 - 196 | 229 - 239 | 1 - 127 | 26 - 35 | 50 - 66 | 99 - 116 | DMYYDILTGYYTGLAFDM (SEQ ID NO: 2880) |
| 1028A07 | 1171 | 141 - 251 | 163 - 176 | 192 - 198 | 231 - 240 | 1 - 125 | 26 - 35 | 50 - 66 | 99 - 114 | VLNYDILTGYYYGMDV (SEQ ID NO: 2832) |
| 1028B08 | 1172 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1028B10 | 1173 | 148 - 258 | 170 - 183 | 199 - 205 | 238 - 247 | 1 - 132 | 26 - 35 | 50 - 68 | 101 - 121 | DFGYYDILTGYYIGAFYAFDI (SEQ ID NO: 2861) |
| 1028C01 | 1174 | 142 - 250 | 165 - 175 | 191 - 197 | 230 - 239 | 1 - 126 | 26 - 37 | 52 - 69 | 102 - 115 | GGHTCHPTCHMGG (SEQ ID NO: 2796) |
| 1028C04 | 1175 | 143 - 253 | 165 - 178 | 194 - 200 | 233 - 242 | 1 - 127 | 26 - 35 | 50 - 66 | 99 - 116 | DMYYDILTGYYTGLAFDM (SEQ ID NO: 2880) |
| 1028C08 | 1176 | 141 - 251 | 163 - 176 | 192 - 198 | 231 - 240 | 1 - 125 | 26 - 35 | 50 - 65 | 99 - 114 | ATYDPLTGYSFDGFDI (SEQ ID NO: 2153) |
| 1028D04 | 1177 | 140 - 247 | 163 - 173 | 189 - 195 | 228 - 236 | 1 - 124 | 26 - 35 | 50 - 65 | 98 - 113 | ATQDILTGYLYSGMDV (SEQ ID NO: 2977) |
| 1028D05 | 1178 | 141 - 248 | 162 - 172 | 188 - 194 | 227 - 237 | 1 - 125 | 26 - 35 | 50 - 66 | 99 - 114 | EHYDILTGYSLLGMDV (SEQ ID NO: 2907) |
| 1028D12 | 1179 | 143 - 250 | 164 - 174 | 190 - 196 | 229 - 239 | 1 - 127 | 26 - 35 | 50 - 66 | 99 - 116 | DGYYDILTGYSYYYGMDV (SEQ ID NO: 2938) |
| 1028E06 | 1180 | 143 - 253 | 165 - 178 | 194 - 200 | 233 - 242 | 1 - 127 | 26 - 35 | 50 - 65 | 98 - 116 | EGSYDILTGYYVGVGRMDV (SEQ ID NO: 2171) |
| 1028E07 | 1181 | 141 - 248 | 162 - 172 | 188 - 194 | 227 - 237 | 1 - 125 | 26 - 35 | 50 - 66 | 99 - 114 | ATYDPLTGYSFDGFDI (SEQ ID NO: 2153) |
| 1028E08 | 1182 | 141 - 248 | 162 - 172 | 188 - 194 | 227 - 237 | 1 - 125 | 26 - 35 | 50 - 66 | 99 - 114 | ATYDPLTGYSFDGFDI (SEQ ID NO: 2153) |
| 1028F06 | 1183 | 146 - 256 | 168 - 180 | 196 - 202 | 235 - 245 | 1 - 130 | 26 - 35 | 50 - 66 | 99 - 119 | DDRRGYYDILTGYYRFGSFDI (SEQ ID NO: 2901) |
| 1028F08 | 1184 | 134 - 244 | 156 - 169 | 185 - 191 | 224 - 233 | 1 - 118 | 26 - 35 | 50 - 66 | 99 - 107 | DIDIGGDDS (SEQ ID NO: 2954) |
| 1028G08 | 1185 | 141 - 251 | 163 - 176 | 192 - 198 | 231 - 240 | 1 - 125 | 26 - 35 | 50 - 65 | 99 - 114 | VSGYNSGYFESYDMDV (SEQ ID NO: 2732) |
| 1028G09 | 1186 | 144 - 254 | 166 - 179 | 195 - 201 | 234 - 243 | 1 - 128 | 26 - 35 | 50 - 66 | 99 - 117 | EVRNYDLLTRSYLAGPLDN (SEQ ID NO: 2751) |
| 1028G10 | 1187 | 141 - 251 | 163 - 176 | 192 - 198 | 231 - 240 | 1 - 125 | 26 - 35 | 50 - 65 | 99 - 114 | ATYDPLTGYSFDGFDI (SEQ ID NO: 2153) |
| 1028H02 | 1188 | 142 - 249 | 165 - 175 | 191 - 197 | 230 - 238 | 1 - 126 | 26 - 37 | 52 - 69 | 102 - 115 | SGEPCITLACNLGG (SEQ ID NO: 2797) |
| 1028H03 | 1189 | 148 - 256 | 169 - 179 | 195 - 201 | 234 - 245 | 1 - 132 | 26 - 35 | 50 - 66 | 99 - 121 | DASEYYDILTGYYLATGRNWFDP (SEQ ID NO: 2888) |
| 1028H06 | 1190 | 145 - 255 | 167 - 180 | 196 - 202 | 235 - 244 | 1 - 129 | 26 - 35 | 50 - 66 | 99 - 118 | DPSPYYDILTGYFLPYYMDV (SEQ ID NO: 2843) |
| 1028H09 | 1191 | 140 - 250 | 162 - 175 | 191 - 197 | 230 - 239 | 1 - 124 | 26 - 35 | 50 - 68 | 101 - 113 | EIDDILTGYYMDV (SEQ ID NO: 2905) |
| 1029A10 | 1192 | 139 - 246 | 160 - 170 | 186 - 192 | 225 - 235 | 1 - 123 | 26 - 35 | 50 - 65 | 98 - 112 | MNYDILTGLVNWFDP (SEQ ID NO: 2786) |
| 1029A12 | 1193 | 137 - 247 | 159 - 171 | 187 - 193 | 226 - 236 | 1 - 121 | 26 - 35 | 50 - 68 | 101 - 110 | RDILTGFYDS (SEQ ID NO: 2933) |
| 1029B11 | 1194 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1029C08 | 1195 | 144 - 254 | 166 - 179 | 195 - 201 | 234 - 243 | 1 - 128 | 26 - 35 | 50 - 66 | 99 - 117 | EGSYDILTGYYVGVGRMDV (SEQ ID NO: 2171) |
| 1029E10 | 1196 | 144 - 254 | 166 - 179 | 195 - 201 | 234 - 243 | 1 - 128 | 26 - 35 | 50 - 65 | 99 - 117 | EVRNYDLLTRSYLAGPLDN (SEQ ID NO: 2751) |
| 1029F08 | 1197 | 144 - 254 | 166 - 179 | 195 - 201 | 234 - 243 | 1 - 128 | 26 - 35 | 50 - 66 | 99 - 117 | EVRNYDLLTRSYLAGPLDN (SEQ ID NO: 2751) |
| 1029G08 | 1198 | 141 - 248 | 162 - 172 | 188 - 194 | 227 - 237 | 1 - 125 | 26 - 35 | 50 - 66 | 99 - 114 | GYYDILTGYQSDAFDI (SEQ ID NO: 2927) |
| 1030A02 | 1199 | 143 - 253 | 165 - 177 | 193 - 199 | 232 - 242 | 1 - 126 | 26 - 35 | 50 - 66 | 99 - 115 | TERFGAKDVTARWGMDV (SEQ ID NO: 2874) |
| 1030A03 | 1200 | 141 - 253 | 163 - 175 | 191 - 197 | 230 - 242 | 1 - 124 | 26 - 35 | 50 - 66 | 99 - 113 | ENYDILTGYYNFFDY (SEQ ID NO: 2737) |
| 1030A04 | 1201 | 141 - 252 | 163 - 176 | 192 - 198 | 231 - 241 | 1 - 124 | 26 - 35 | 50 - 66 | 99 - 113 | RQYDILTGYYGGFDY (SEQ ID NO: 2958) |
| 1030A05 | 1202 | 141 - 249 | 163 - 175 | 191 - 197 | 230 - 238 | 1 - 124 | 26 - 34 | 49 - 65 | 98 - 113 | ELGLSIVGATTGALDM (SEQ ID NO: 2174) |
| 1030A09 | 1203 | 140 - 250 | 162 - 174 | 190 - 196 | 229 - 239 | 1 - 123 | 26 - 35 | 50 - 66 | 99 - 112 | RYGDPFYYYYYMNV (SEQ ID NO: 2755) |
| 1030A12 | 1204 | 141 - 249 | 163 - 173 | 189 - 195 | 228 - 238 | 1 - 123 | 26 - 35 | 50 - 66 | 99 - 112 | RYGDPFYYYYYMNV (SEQ ID NO: 2755) |
| 1030B06 | 1205 | 141 - 249 | 163 - 173 | 189 - 195 | 228 - 238 | 1 - 123 | 26 - 35 | 50 - 66 | 99 - 112 | RYGDPFYYYYYMNV (SEQ ID NO: 2755) |
| 1030B08 | 1206 | 141 - 247 | 163 - 173 | 189 - 195 | 228 - 236 | 1 - 124 | 26 - 34 | 49 - 65 | 98 - 113 | ELGLSIVGATTGALDM (SEQ ID NO: 2174) |
| 1030B10 | 1207 | 143 - 251 | 165 - 175 | 191 - 197 | 230 - 240 | 1 - 125 | 26 - 35 | 50 - 66 | 99 - 114 | ELGHREGGYWYSPYNV (SEQ ID NO: 2838) |
| 1030C03 | 1208 | 140 - 252 | 162 - 175 | 191 - 197 | 230 - 241 | 1 - 123 | 26 - 35 | 50 - 66 | 99 - 112 | RYGDPFYYYYYMNV (SEQ ID NO: 2755) |
| 1030C06 | 1209 | 147 - 256 | 169 - 182 | 198 - 204 | 237 - 245 | 1 - 130 | 26 - 35 | 50 - 68 | 101 - 119 | DPGNYDILTGYYYYYGMDV (SEQ ID NO: 2935) |
| 1030C08 | 1210 | 134 - 244 | 156 - 168 | 184 - 190 | 223 - 233 | 1 - 117 | 26 - 35 | 50 - 66 | 99 - 106 | SGPGWFDP (SEQ ID NO: 2870) |
| 1030C09 | 1211 | 141 - 251 | 163 - 175 | 191 - 197 | 230 - 240 | 1 - 124 | 26 - 34 | 49 - 65 | 98 - 113 | ELGLSIVGATTGALDM (SEQ ID NO: 2174) |

| | | | | | | | | | | |
|---|---|---|---|---|---|---|---|---|---|---|
| 1030C10 | 1212 | 141 - 250 | 163 - 175 | 191 - 197 | 230 - 239 | 1 - 124 | 26 - 34 | 49 - 65 | 98 - 113 | ELGLSIVGATTGALDM (SEQ ID NO: 2174) |
| 1030C11 | 1213 | 140 - 251 | 162 - 175 | 191 - 197 | 230 - 240 | 1 - 123 | 26 - 35 | 50 - 66 | 99 - 112 | RYGDPFYYYYYMNV (SEQ ID NO: 2755) |
| 1030C12 | 1214 | 134 - 244 | 156 - 168 | 184 - 190 | 223 - 233 | 1 - 117 | 26 - 35 | 50 - 66 | 99 - 106 | SGPGWFDP (SEQ ID NO: 2870) |
| 1030D07 | 1215 | 141 - 249 | 163 - 173 | 189 - 195 | 228 - 238 | 1 - 123 | 26 - 35 | 50 - 66 | 99 - 112 | RYGDPFYYYYYMNV (SEQ ID NO: 2755) |
| 1030D12 | 1216 | 141 - 251 | 163 - 175 | 191 - 197 | 230 - 240 | 1 - 124 | 26 - 34 | 49 - 65 | 98 - 113 | ELGLSIVGATTGALDM (SEQ ID NO: 2174) |
| 1030E02 | 1217 | 140 - 251 | 162 - 175 | 191 - 197 | 230 - 240 | 1 - 123 | 26 - 35 | 50 - 66 | 99 - 112 | RYGDPFYYYYYMNV (SEQ ID NO: 2755) |
| 1030E05 | 1218 | 142 - 252 | 164 - 176 | 192 - 198 | 231 - 241 | 1 - 124 | 26 - 34 | 49 - 65 | 98 - 113 | ELGLSIVGATTGALDM (SEQ ID NO: 2174) |
| 1030E07 | 1219 | 142 - 251 | 165 - 176 | 192 - 198 | 231 - 240 | 1 - 124 | 26 - 34 | 49 - 65 | 98 - 113 | ELGLSIVGATTGALDM (SEQ ID NO: 2174) |
| 1030E08 | 1220 | 141 - 251 | 163 - 175 | 191 - 197 | 230 - 240 | 1 - 124 | 26 - 34 | 49 - 65 | 98 - 113 | ELGLSIVGATTGALDM (SEQ ID NO: 2174) |
| 1030E09 | 1221 | 141 - 252 | 163 - 176 | 192 - 198 | 231 - 241 | 1 - 124 | 26 - 34 | 49 - 65 | 98 - 113 | ELGLSIVGATTGALDM (SEQ ID NO: 2174) |
| 1030E10 | 1222 | 140 - 250 | 162 - 174 | 190 - 196 | 229 - 239 | 1 - 123 | 26 - 35 | 50 - 66 | 99 - 112 | RYGDPFYYYYYMNV (SEQ ID NO: 2755) |
| 1030F02 | 1223 | 142 - 252 | 164 - 176 | 192 - 198 | 231 - 241 | 1 - 125 | 26 - 37 | 52 - 67 | 100 - 114 | AGYDLLTGYPFYFDS (SEQ ID NO: 2757) |
| 1030F05 | 1224 | 141 - 251 | 163 - 175 | 191 - 197 | 230 - 240 | 1 - 124 | 26 - 34 | 49 - 65 | 98 - 113 | ELGLSIVGATTGALDM (SEQ ID NO: 2174) |
| 1030F06 | 1225 | 140 - 251 | 162 - 175 | 191 - 197 | 230 - 240 | 1 - 123 | 26 - 35 | 50 - 66 | 99 - 112 | RYGDPFYYYYYMNV (SEQ ID NO: 2755) |
| 1030F08 | 1226 | 141 - 254 | 163 - 176 | 192 - 198 | 231 - 243 | 1 - 124 | 26 - 34 | 49 - 65 | 98 - 113 | ELGLSIVGATTGALDM (SEQ ID NO: 2174) |
| 1030F09 | 1227 | 142 - 253 | 164 - 176 | 192 - 198 | 231 - 242 | 1 - 124 | 26 - 34 | 49 - 65 | 98 - 113 | ELGLSIVGATTGALDM (SEQ ID NO: 2174) |
| 1030F11 | 1228 | 140 - 250 | 162 - 174 | 190 - 196 | 229 - 239 | 1 - 123 | 26 - 35 | 50 - 66 | 99 - 112 | RYGDPFYYYYYMNV (SEQ ID NO: 2755) |
| 1030F12 | 1229 | 141 - 251 | 163 - 175 | 191 - 197 | 230 - 240 | 1 - 124 | 26 - 35 | 50 - 66 | 99 - 113 | DNYDILTGYSRRFDP (SEQ ID NO: 2942) |
| 1030G03 | 1230 | 141 - 256 | 163 - 176 | 192 - 202 | 237 - 245 | 1 - 124 | 26 - 34 | 49 - 65 | 98 - 113 | ELGLSIVGATTGALDM (SEQ ID NO: 2174) |
| 1030G07 | 1231 | 140 - 251 | 162 - 175 | 191 - 197 | 230 - 240 | 1 - 123 | 26 - 35 | 50 - 66 | 99 - 112 | RYGDPFYYYYYMNV (SEQ ID NO: 2755) |
| 1030G09 | 1232 | 142 - 251 | 164 - 174 | 190 - 196 | 229 - 240 | 1 - 124 | 26 - 34 | 49 - 65 | 98 - 113 | ELGLSIVGATTGALDM (SEQ ID NO: 2174) |
| 1030H05 | 1233 | 146 - 255 | 168 - 181 | 197 - 203 | 236 - 244 | 1 - 129 | 26 - 35 | 50 - 66 | 99 - 118 | DRGGNYDILTGYYFHHGVDV (SEQ ID NO: 2914) |
| 1030H06 | 1234 | 148 - 258 | 170 - 182 | 198 - 204 | 239 - 247 | 1 - 130 | 26 - 37 | 52 - 69 | 102 - 119 | ATKSYDILTRMYYYHMDV (SEQ ID NO: 2748) |
| 1030H10 | 1235 | 141 - 253 | 163 - 176 | 192 - 198 | 231 - 242 | 1 - 124 | 26 - 35 | 50 - 66 | 99 - 113 | DNYDILTGYSRRFDP (SEQ ID NO: 2942) |
| 1030H11 | 1236 | 142 - 252 | 164 - 176 | 192 - 198 | 231 - 241 | 1 - 124 | 26 - 34 | 49 - 65 | 98 - 113 | ELGLSIVGATTGALDM (SEQ ID NO: 2174) |
| 1031A01 | 1237 | 138 - 248 | 160 - 173 | 189 - 195 | 228 - 237 | 1 - 121 | 26 - 35 | 50 - 66 | 99 - 110 | GYDSSAFRAFDI (SEQ ID NO: 2136) |
| 1031A03 | 1238 | 143 - 251 | 166 - 176 | 192 - 198 | 231 - 240 | 1 - 125 | 26 - 35 | 50 - 66 | 99 - 114 | PYYDPLTAYTFQYFGN (SEQ ID NO: 2806) |
| 1031A08 | 1239 | 148 - 258 | 170 - 182 | 198 - 204 | 237 - 247 | 1 - 131 | 26 - 35 | 50 - 66 | 99 - 120 | GREDTDKVKPWDRYYHYYYMDV (SEQ ID NO: 2809) |
| 1031A12 | 1240 | 147 - 257 | 169 - 181 | 197 - 203 | 236 - 246 | 1 - 130 | 26 - 35 | 50 - 66 | 99 - 119 | GREDTDKVKPWDRYYHYYMDV (SEQ ID NO: 2972) |
| 1031B03 | 1241 | 137 - 246 | 159 - 172 | 188 - 194 | 227 - 235 | 1 - 120 | 26 - 35 | 50 - 68 | 101 - 109 | GLGHTDSDS (SEQ ID NO: 2959) |
| 1031B06 | 1242 | 143 - 253 | 165 - 177 | 193 - 199 | 232 - 242 | 1 - 126 | 26 - 35 | 50 - 66 | 99 - 115 | AKGYYYDSSGASDVFDV (SEQ ID NO: 2871) |
| 1031B07 | 1243 | 148 - 258 | 170 - 182 | 198 - 204 | 237 - 247 | 1 - 131 | 26 - 35 | 50 - 66 | 99 - 120 | GREDTDKVKPWDRYYHYYYMDV (SEQ ID NO: 2809) |
| 1031B08 | 1244 | 149 - 260 | 171 - 183 | 199 - 205 | 238 - 249 | 1 - 131 | 26 - 35 | 50 - 66 | 99 - 120 | SSPPKWYDALTGHSSYHSAMDV (SEQ ID NO: 2159) |
| 1031B09 | 1245 | 148 - 258 | 170 - 182 | 198 - 204 | 237 - 247 | 1 - 131 | 26 - 35 | 50 - 66 | 99 - 120 | SNPPKWYDALTGHSSYHSAMDV (SEQ ID NO: 2840) |
| 1031B11 | 1246 | 138 - 248 | 160 - 172 | 188 - 194 | 227 - 237 | 1 - 121 | 26 - 35 | 50 - 66 | 99 - 110 | GYDSSAFRAFDI (SEQ ID NO: 2136) |
| 1031B12 | 1247 | 148 - 259 | 170 - 183 | 199 - 205 | 238 - 248 | 1 - 131 | 26 - 35 | 50 - 66 | 99 - 120 | GREDTDKVKPWDRYYHYYYMDV (SEQ ID NO: 2809) |
| 1031C01 | 1248 | 138 - 248 | 160 - 172 | 188 - 194 | 227 - 237 | 1 - 121 | 26 - 35 | 50 - 66 | 99 - 110 | GYDSSAFRAFDI (SEQ ID NO: 2136) |
| 1031C02 | 1249 | 142 - 253 | 164 - 177 | 193 - 199 | 232 - 242 | 1 - 125 | 26 - 35 | 50 - 66 | 99 - 114 | PFYDTLTSYVFQYFDH (SEQ ID NO: 2137) |
| 1031C04 | 1250 | 149 - 260 | 171 - 183 | 199 - 205 | 238 - 249 | 1 - 131 | 26 - 35 | 50 - 66 | 99 - 120 | GRKDTDKVKPWDRYYHYYYMDV (SEQ ID NO: 2813) |
| 1031C08 | 1251 | 139 - 248 | 161 - 171 | 187 - 193 | 226 - 237 | 1 - 121 | 26 - 35 | 50 - 66 | 99 - 110 | GYDSSAFRAFDI (SEQ ID NO: 2136) |
| 1031C11 | 1252 | 149 - 257 | 171 - 181 | 197 - 203 | 236 - 246 | 1 - 131 | 26 - 35 | 50 - 66 | 99 - 120 | GREDTDKVKPWDRYYHYYYMDV (SEQ ID NO: 2809) |
| 1031D01 | 1253 | 146 - 256 | 168 - 180 | 196 - 202 | 235 - 245 | 1 - 129 | 26 - 35 | 50 - 66 | 99 - 118 | AATTSQKHNKYAYYFYGMDV (SEQ ID NO: 2131) |

| | | | | | | | | | | |
|---|---|---|---|---|---|---|---|---|---|---|
| 1031D04 | 1254 | 138 - 248 | 160 - 172 | 188 - 194 | 227 - 237 | 1 - 121 | 26 - 35 | 50 - 66 | 99 - 110 | GYDSSAFRAFDI (SEQ ID NO: 2136) |
| 1031D06 | 1255 | 148 - 258 | 170 - 182 | 198 - 204 | 237 - 247 | 1 - 131 | 26 - 35 | 50 - 66 | 99 - 120 | GREDTDKVKLWDRYYHYYYMDV (SEQ ID NO: 2887) |
| 1031D08 | 1256 | 145 - 257 | 167 - 180 | 196 - 202 | 235 - 246 | 1 - 128 | 26 - 35 | 50 - 66 | 99 - 117 | VRPKLRYFDWLSRHDAFDL (SEQ ID NO: 2820) |
| 1031D09 | 1257 | 139 - 247 | 161 - 171 | 187 - 193 | 226 - 236 | 1 - 121 | 26 - 35 | 50 - 66 | 99 - 110 | GYDSSAFRAFDI (SEQ ID NO: 2136) |
| 1031D11 | 1258 | 149 - 256 | 171 - 181 | 197 - 203 | 236 - 245 | 1 - 131 | 26 - 35 | 50 - 66 | 99 - 120 | SSPPKWYDALTGDSSYHSAMDV (SEQ ID NO: 2165) |
| 1031D12 | 1259 | 146 - 254 | 168 - 178 | 194 - 200 | 233 - 243 | 1 - 128 | 26 - 35 | 50 - 66 | 99 - 117 | DKAHGEYGRDYYYYYGMDV (SEQ ID NO: 2735) |
| 1031E01 | 1260 | 148 - 258 | 170 - 182 | 198 - 204 | 237 - 247 | 1 - 131 | 26 - 35 | 50 - 66 | 99 - 120 | SSPPKWYDALTGHSSYHSAMDV (SEQ ID NO: 2159) |
| 1031E05 | 1261 | 149 - 257 | 171 - 181 | 197 - 203 | 236 - 246 | 1 - 131 | 26 - 35 | 50 - 66 | 99 - 120 | SQPPKWYDALTGHSSYHSAMDV (SEQ ID NO: 2848) |
| 1031E07 | 1262 | 148 - 259 | 170 - 182 | 198 - 204 | 237 - 248 | 1 - 131 | 26 - 35 | 50 - 66 | 99 - 120 | SSPPKWYDALTGHSSYHSAMDV (SEQ ID NO: 2159) |
| 1031E08 | 1263 | 148 - 259 | 170 - 183 | 199 - 205 | 238 - 248 | 1 - 131 | 26 - 35 | 50 - 66 | 99 - 120 | GREDTDKVKPWDRYYHYYYMDV (SEQ ID NO: 2809) |
| 1031E09 | 1264 | 139 - 246 | 162 - 173 | 189 - 195 | 228 - 235 | 1 - 121 | 26 - 35 | 50 - 66 | 99 - 110 | GYDSSAFRAFDI (SEQ ID NO: 2136) |
| 1031E10 | 1265 | 148 - 258 | 170 - 182 | 198 - 204 | 237 - 247 | 1 - 131 | 26 - 35 | 50 - 66 | 99 - 120 | SSPPKWYDALTGDSSYHSAMDV (SEQ ID NO: 2165) |
| 1031E11 | 1266 | 148 - 258 | 170 - 182 | 198 - 204 | 237 - 247 | 1 - 131 | 26 - 35 | 50 - 66 | 99 - 120 | SSPPKWYDALTGHSSYHSAMDV (SEQ ID NO: 2159) |
| 1031F01 | 1267 | 138 - 248 | 160 - 172 | 188 - 194 | 227 - 237 | 1 - 121 | 26 - 35 | 50 - 66 | 99 - 110 | GYDSSAFRAFDI (SEQ ID NO: 2136) |
| 1031F04 | 1268 | 139 - 246 | 162 - 172 | 188 - 194 | 227 - 235 | 1 - 121 | 26 - 35 | 50 - 66 | 99 - 110 | GYDSSAFRAFDI (SEQ ID NO: 2136) |
| 1031F06 | 1269 | 137 - 247 | 159 - 171 | 187 - 193 | 226 - 236 | 1 - 119 | 26 - 35 | 50 - 66 | 99 - 108 | DTVRSGGMDV (SEQ ID NO: 2804) |
| 1031F10 | 1270 | 148 - 259 | 170 - 183 | 199 - 205 | 238 - 248 | 1 - 131 | 26 - 35 | 50 - 66 | 99 - 120 | GREDTDKVKPWDRYYHYYYMDV (SEQ ID NO: 2809) |
| 1031F11 | 1271 | 145 - 255 | 167 - 179 | 195 - 201 | 234 - 244 | 1 - 128 | 26 - 35 | 50 - 66 | 99 - 117 | DKAHGEYGRDYYYYYGMDV (SEQ ID NO: 2735) |
| 1031F12 | 1272 | 138 - 249 | 160 - 172 | 188 - 194 | 227 - 238 | 1 - 121 | 26 - 35 | 50 - 66 | 99 - 110 | GYDSSAFRAFDI (SEQ ID NO: 2136) |
| 1031G01 | 1273 | 138 - 248 | 160 - 172 | 188 - 194 | 227 - 237 | 1 - 121 | 26 - 35 | 50 - 66 | 99 - 110 | GYDSSAFRAFDI (SEQ ID NO: 2136) |
| 1031G03 | 1274 | 148 - 258 | 170 - 182 | 198 - 204 | 237 - 247 | 1 - 131 | 26 - 35 | 50 - 66 | 99 - 120 | SSPPKWYDALTGHSSYHSAMDV (SEQ ID NO: 2159) |
| 1031G05 | 1275 | 148 - 259 | 170 - 183 | 199 - 205 | 238 - 248 | 1 - 131 | 26 - 35 | 50 - 66 | 99 - 120 | GREDTDKVKPWDRYYHYYYMDV (SEQ ID NO: 2809) |
| 1031G06 | 1276 | 148 - 258 | 170 - 182 | 198 - 204 | 237 - 247 | 1 - 131 | 26 - 35 | 50 - 66 | 99 - 120 | GREDTDKVKPWDRYYHYYYMDV (SEQ ID NO: 2809) |
| 1031G07 | 1277 | 149 - 259 | 171 - 183 | 199 - 205 | 238 - 248 | 1 - 131 | 26 - 35 | 50 - 66 | 99 - 120 | SSPPKWYDALTGDSSYHSAMGV (SEQ ID NO: 2816) |
| 1031G09 | 1278 | 148 - 263 | 170 - 183 | 199 - 209 | 244 - 252 | 1 - 131 | 26 - 35 | 50 - 66 | 99 - 120 | GREDTDKVKPWDRYYHYYYMDV (SEQ ID NO: 2809) |
| 1031G12 | 1279 | 146 - 256 | 168 - 180 | 196 - 202 | 235 - 245 | 1 - 129 | 26 - 35 | 50 - 66 | 99 - 118 | AATTSQKHNKYAYYFYGMDV (SEQ ID NO: 2131) |
| 1031H01 | 1280 | 138 - 250 | 160 - 173 | 189 - 195 | 228 - 239 | 1 - 121 | 26 - 35 | 50 - 66 | 99 - 110 | GYDSSAFRAFDI (SEQ ID NO: 2136) |
| 1031H02 | 1281 | 143 - 255 | 165 - 178 | 194 - 200 | 233 - 244 | 1 - 126 | 26 - 35 | 50 - 66 | 99 - 115 | AKGYYYDSSGASDVFDV (SEQ ID NO: 2871) |
| 1031H03 | 1282 | 148 - 260 | 170 - 183 | 199 - 205 | 238 - 249 | 1 - 131 | 26 - 35 | 50 - 66 | 99 - 120 | GREDTDKVKPWDRYYHYYYMDV (SEQ ID NO: 2809) |
| 1031H06 | 1283 | 145 - 257 | 167 - 179 | 195 - 201 | 234 - 246 | 1 - 128 | 26 - 35 | 50 - 66 | 99 - 117 | DKAHGEYGRDYYYYYGMDV (SEQ ID NO: 2735) |
| 1031H09 | 1284 | 145 - 255 | 167 - 179 | 195 - 201 | 234 - 244 | 1 - 128 | 26 - 35 | 50 - 66 | 99 - 117 | DKAHGEYGRDYYYYYGMDV (SEQ ID NO: 2735) |
| 1031H10 | 1285 | 144 - 256 | 166 - 179 | 195 - 201 | 234 - 245 | 1 - 127 | 26 - 35 | 50 - 66 | 99 - 116 | ERGYTGYDRLVGGYYFDF (SEQ ID NO: 2931) |
| 1031H11 | 1286 | 136 - 246 | 158 - 170 | 186 - 192 | 225 - 235 | 1 - 119 | 26 - 35 | 50 - 66 | 99 - 108 | DTVRSGGMDV (SEQ ID NO: 2804) |
| 1033A08 | 1287 | 144 - 254 | 166 - 179 | 195 - 201 | 234 - 243 | 1 - 128 | 26 - 37 | 52 - 69 | 102 - 117 | DRYDILTGYYYYGMDV (SEQ ID NO: 2129) |
| 1033B11 | 1288 | 144 - 254 | 166 - 179 | 195 - 201 | 234 - 243 | 1 - 128 | 26 - 37 | 52 - 69 | 102 - 117 | DRYDILTGYYYYGMDV (SEQ ID NO: 2129) |
| 1033C01 | 1289 | 144 - 254 | 166 - 179 | 195 - 201 | 234 - 243 | 1 - 128 | 26 - 35 | 50 - 66 | 99 - 117 | EVRNYDLLTRSYLAGPLDN (SEQ ID NO: 2751) |
| 1033C08 | 1290 | 142 - 249 | 163 - 173 | 189 - 195 | 228 - 238 | 1 - 126 | 26 - 35 | 50 - 66 | 99 - 115 | EMGYDILTGYYLNYMDV (SEQ ID NO: 2862) |
| 1033D02 | 1291 | 138 - 245 | 161 - 171 | 187 - 193 | 226 - 234 | 1 - 122 | 26 - 35 | 50 - 66 | 99 - 111 | GDYDILTGYYMDV (SEQ ID NO: 2781) |
| 1033D03 | 1292 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1033D05 | 1293 | 141 - 248 | 162 - 172 | 188 - 194 | 227 - 237 | 1 - 125 | 26 - 35 | 50 - 66 | 99 - 114 | ATYDPLTGYSFDGFDI (SEQ ID NO: 2153) |
| 1033D11 | 1294 | 140 - 247 | 161 - 171 | 187 - 193 | 226 - 236 | 1 - 124 | 26 - 35 | 50 - 66 | 99 - 113 | VKRDILTGYVEGMDV (SEQ ID NO: 2869) |
| 1033D12 | 1295 | 144 - 254 | 166 - 179 | 195 - 201 | 234 - 243 | 1 - 128 | 26 - 35 | 50 - 66 | 99 - 117 | GGPHYDILTGYYMAVGFDI (SEQ ID NO: 2962) |

| | | | | | | | | | | |
|---|---|---|---|---|---|---|---|---|---|---|
| 1033E01 | 1296 | 139 - 249 | 161 - 173 | 189 - 195 | 228 - 238 | 1 - 123 | 26 - 35 | 50 - 66 | 99 - 112 | DIDARLAALDAFDI (SEQ ID NO: 2794) |
| 1033E06 | 1297 | 141 - 251 | 163 - 176 | 192 - 198 | 231 - 240 | 1 - 125 | 26 - 35 | 50 - 66 | 99 - 114 | ATHDPLTGYSFDGFDI (SEQ ID NO: 2780) |
| 1033E11 | 1298 | 143 - 253 | 165 - 177 | 193 - 199 | 232 - 242 | 1 - 127 | 26 - 35 | 50 - 66 | 99 - 116 | HRSRSCSSTSCRNDAFDI (SEQ ID NO: 2770) |
| 1033E12 | 1299 | 142 - 249 | 163 - 173 | 189 - 195 | 228 - 238 | 1 - 126 | 26 - 35 | 50 - 66 | 99 - 115 | EMGYDILTGYYLNYMDV (SEQ ID NO: 2862) |
| 1033F03 | 1300 | 139 - 246 | 160 - 170 | 186 - 192 | 225 - 235 | 1 - 123 | 26 - 35 | 50 - 66 | 99 - 112 | EGAADYLNGQYFQD (SEQ ID NO: 2768) |
| 1033F08 | 1301 | 145 - 256 | 167 - 179 | 195 - 201 | 234 - 245 | 1 - 129 | 26 - 35 | 50 - 66 | 99 - 118 | QKVYYDILTGYNYYYYGMDV (SEQ ID NO: 2767) |
| 1033F10 | 1302 | 144 - 254 | 166 - 179 | 195 - 201 | 234 - 243 | 1 - 128 | 26 - 35 | 50 - 66 | 99 - 117 | EVRNYDLLTRSYLAGPLDN (SEQ ID NO: 2751) |
| 1033F12 | 1303 | 134 - 241 | 155 - 165 | 181 - 187 | 220 - 230 | 1 - 118 | 26 - 35 | 50 - 66 | 99 - 107 | DIDIGGDDS (SEQ ID NO: 2954) |
| 1033G01 | 1304 | 143 - 253 | 165 - 178 | 194 - 200 | 233 - 242 | 1 - 127 | 24 - 33 | 48 - 64 | 97 - 116 | EGGNYDILTGYYIGNGAFDI (SEQ ID NO: 2158) |
| 1033G03 | 1305 | 142 - 249 | 163 - 173 | 189 - 195 | 228 - 238 | 1 - 126 | 26 - 35 | 50 - 66 | 99 - 115 | PQGVTLVRGAEIDAFAI (SEQ ID NO: 2925) |
| 1033G08 | 1306 | 141 - 248 | 162 - 172 | 188 - 194 | 227 - 237 | 1 - 125 | 26 - 35 | 50 - 66 | 99 - 114 | ATYDPLTGYSFDGFDI (SEQ ID NO: 2153) |
| 1033H04 | 1307 | 140 - 247 | 161 - 171 | 187 - 193 | 226 - 236 | 1 - 124 | 25 - 34 | 49 - 65 | 98 - 113 | ATYDPLTGYSFDGFDI (SEQ ID NO: 2153) |
| 1037A05 | 1308 | 139 - 246 | 160 - 170 | 186 - 192 | 225 - 235 | 1 - 123 | 26 - 35 | 50 - 66 | 99 - 112 | SRDLLLFPHYGMDV (SEQ ID NO: 2133) |
| 1037B03 | 1309 | 141 - 251 | 163 - 175 | 191 - 197 | 230 - 240 | 1 - 125 | 26 - 35 | 50 - 66 | 99 - 114 | SHYDILTRLNYWYFDL (SEQ ID NO: 2950) |
| 1037B04 | 1310 | 144 - 251 | 167 - 177 | 193 - 199 | 232 - 240 | 1 - 128 | 26 - 35 | 50 - 66 | 99 - 117 | DPGYYDILTGYFHRYGMDV (SEQ ID NO: 2922) |
| 1037C04 | 1311 | 142 - 252 | 164 - 177 | 193 - 199 | 232 - 241 | 1 - 126 | 26 - 35 | 50 - 65 | 98 - 115 | ENGDYDILTGQTFYGMDV (SEQ ID NO: 2752) |
| 1037C06 | 1312 | 141 - 249 | 163 - 173 | 189 - 195 | 228 - 238 | 1 - 125 | 26 - 35 | 50 - 66 | 99 - 114 | LYYDILTGYHWDAFDI (SEQ ID NO: 2882) |
| 1037C08 | 1313 | 140 - 250 | 162 - 175 | 191 - 197 | 230 - 239 | 1 - 124 | 26 - 35 | 50 - 66 | 99 - 113 | DGIDILLVPAALMDV (SEQ ID NO: 2160) |
| 1037D11 | 1314 | 136 - 246 | 158 - 171 | 187 - 193 | 226 - 235 | 1 - 120 | 26 - 35 | 50 - 66 | 99 - 109 | SQWLEHDVFDI (SEQ ID NO: 2864) |
| 1037E06 | 1315 | 144 - 251 | 165 - 175 | 191 - 197 | 230 - 240 | 1 - 128 | 26 - 35 | 50 - 66 | 99 - 117 | DRRDYDLLTRYYYYYGMDV (SEQ ID NO: 2928) |
| 1037F04 | 1316 | 144 - 251 | 165 - 175 | 191 - 197 | 230 - 240 | 1 - 128 | 26 - 35 | 50 - 65 | 98 - 117 | XQRGDYDILTGYQLGYAFDI (SEQ ID NO: 2808) |
| 1037G01 | 1317 | 141 - 251 | 163 - 176 | 192 - 198 | 231 - 240 | 1 - 125 | 26 - 35 | 50 - 66 | 99 - 114 | SHYDILTRLNYWYFDL (SEQ ID NO: 2950) |
| 1037G03 | 1318 | 146 - 256 | 168 - 181 | 197 - 203 | 236 - 245 | 1 - 130 | 26 - 35 | 50 - 66 | 99 - 119 | DLGSFYDILTALRLENYGMDV (SEQ ID NO: 2963) |
| 1037G10 | 1319 | 140 - 250 | 162 - 175 | 191 - 197 | 230 - 239 | 1 - 124 | 26 - 35 | 50 - 66 | 99 - 113 | DYYDILTKLPYGMDV (SEQ ID NO: 2975) |
| 1042A07 | 1320 | 144 - 251 | 167 - 177 | 193 - 199 | 232 - 240 | 1 - 128 | 26 - 35 | 50 - 66 | 99 - 117 | VSPSYDILTGYYLPHAFDV (SEQ ID NO: 2849) |
| 1042A10 | 1321 | 142 - 249 | 165 - 175 | 191 - 197 | 230 - 238 | 1 - 126 | 26 - 35 | 50 - 65 | 98 - 115 | GPRYYDILTGYRYNWFDP (SEQ ID NO: 2801) |
| 1042B03 | 1322 | 140 - 247 | 161 - 171 | 187 - 193 | 226 - 236 | 1 - 124 | 26 - 35 | 50 - 66 | 99 - 113 | DIDDILTGYVLGMDV (SEQ ID NO: 2924) |
| 1042B12 | 1323 | 141 - 248 | 162 - 172 | 188 - 194 | 227 - 237 | 1 - 125 | 26 - 35 | 50 - 66 | 99 - 114 | SHYDILTGLNYWYFDL (SEQ ID NO: 2166) |
| 1042D01 | 1324 | 136 - 246 | 158 - 171 | 187 - 193 | 226 - 235 | 1 - 120 | 26 - 35 | 50 - 66 | 99 - 109 | QQWLPYDAFDI (SEQ ID NO: 2839) |
| 1042D03 | 1325 | 140 - 250 | 162 - 175 | 191 - 197 | 230 - 239 | 1 - 124 | 26 - 35 | 50 - 68 | 101 - 113 | AYYDILTGYFFDI (SEQ ID NO: 2873) |
| 1042D10 | 1326 | 142 - 252 | 164 - 177 | 193 - 199 | 232 - 241 | 1 - 126 | 26 - 35 | 50 - 65 | 98 - 115 | ERADYDILTGYYFYGMDV (SEQ ID NO: 2802) |
| 1042E10 | 1327 | 147 - 257 | 169 - 182 | 198 - 204 | 237 - 246 | 1 - 131 | 26 - 37 | 52 - 69 | 102 - 120 | ERPYYDILTGYTVTYGMDV (SEQ ID NO: 2798) |
| 1042E11 | 1328 | 140 - 247 | 161 - 171 | 187 - 193 | 226 - 236 | 1 - 124 | 26 - 35 | 50 - 66 | 99 - 113 | DEYDILTGLLQGMDV (SEQ ID NO: 2883) |
| 1042F08 | 1329 | 142 - 252 | 164 - 177 | 193 - 199 | 232 - 241 | 1 - 126 | 26 - 37 | 52 - 67 | 100 - 115 | GDYDILTGYPLHAFDI (SEQ ID NO: 2738) |
| 1042F12 | 1330 | 140 - 247 | 161 - 171 | 187 - 193 | 226 - 236 | 1 - 124 | 26 - 35 | 50 - 66 | 99 - 113 | DGYDILTGYYFGMDV (SEQ ID NO: 2976) |
| 1042G08 | 1331 | 141 - 248 | 162 - 172 | 188 - 194 | 227 - 237 | 1 - 125 | 26 - 35 | 50 - 66 | 99 - 114 | EHYDILTGYSLLGMDV (SEQ ID NO: 2907) |
| 1042G10 | 1332 | 141 - 251 | 163 - 176 | 192 - 198 | 231 - 240 | 1 - 125 | 26 - 35 | 50 - 66 | 99 - 114 | SHYDILTGLNYWYFDL (SEQ ID NO: 2166) |
| 1042H03 | 1333 | 143 - 253 | 165 - 178 | 194 - 200 | 233 - 242 | 1 - 127 | 26 - 35 | 50 - 65 | 98 - 116 | GSLYYDILTGYYIGNAFDI (SEQ ID NO: 2759) |
| 1043A03 | 1334 | 144 - 254 | 166 - 179 | 195 - 201 | 234 - 243 | 1 - 128 | 26 - 35 | 50 - 66 | 99 - 117 | DGYYDILTGGFYYYYGMDV (SEQ ID NO: 2899) |
| 1043B02 | 1335 | 142 - 249 | 163 - 173 | 189 - 195 | 228 - 238 | 1 - 126 | 26 - 35 | 50 - 65 | 98 - 115 | GGYYDILTGYLVYYGMDV (SEQ ID NO: 2744) |
| 1043B03 | 1336 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1043B06 | 1337 | 143 - 253 | 165 - 178 | 194 - 200 | 233 - 242 | 1 - 127 | 26 - 35 | 50 - 66 | 99 - 116 | DQQYDILTGYHIDYYMDV (SEQ ID NO: 2828) |

| | | | | | | | | | | |
|---|---|---|---|---|---|---|---|---|---|---|
| 1043D07 | 1338 | 141 - 251 | 163 - 176 | 192 - 198 | 231 - 240 | 1 - 125 | 26 - 35 | 50 - 65 | 99 - 114 | ATYDPLTGYSFDGFDI (SEQ ID NO: 2153) |
| 1043B09 | 1339 | 143 - 253 | 165 - 178 | 194 - 200 | 233 - 242 | 1 - 127 | 26 - 35 | 50 - 65 | 98 - 116 | HVRDYDILTGYYRGHHFDY (SEQ ID NO: 2727) |
| 1043D11 | 1340 | 144 - 254 | 166 - 179 | 195 - 201 | 234 - 243 | 1 - 128 | 26 - 35 | 50 - 66 | 99 - 117 | EVRNYDLLTRSYLAGPLDN (SEQ ID NO: 2751) |
| 1043E05 | 1341 | 143 - 250 | 164 - 174 | 190 - 196 | 229 - 239 | 1 - 127 | 26 - 35 | 50 - 66 | 99 - 116 | TESNYDILTGYYWPSMDV (SEQ ID NO: 2940) |
| 1043F01 | 1342 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1043F04 | 1343 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1043F12 | 1344 | 143 - 250 | 164 - 174 | 190 - 196 | 229 - 239 | 1 - 127 | 26 - 35 | 50 - 66 | 99 - 116 | TESNYDILTGYYWPSMDV (SEQ ID NO: 2940) |
| 1043H07 | 1345 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1044A11 | 1346 | 144 - 251 | 165 - 175 | 191 - 197 | 230 - 240 | 1 - 128 | 26 - 35 | 50 - 68 | 101 - 117 | APYDILTGYSDYYGMDV (SEQ ID NO: 2968) |
| 1044B11 | 1347 | 139 - 249 | 161 - 173 | 189 - 195 | 228 - 238 | 1 - 123 | 26 - 35 | 50 - 66 | 99 - 112 | DSDARLAALDAFDI (SEQ ID NO: 2978) |
| 1044C09 | 1348 | 140 - 250 | 162 - 174 | 190 - 196 | 229 - 239 | 1 - 124 | 26 - 35 | 50 - 66 | 99 - 113 | GQFGVLPNYYYHMDV (SEQ ID NO: 2943) |
| 1044C10 | 1349 | 143 - 253 | 165 - 177 | 193 - 199 | 232 - 242 | 1 - 127 | 26 - 35 | 50 - 66 | 99 - 116 | DIKRYNSNWPYYDYYMDV (SEQ ID NO: 2726) |
| 1044D03 | 1350 | 144 - 254 | 166 - 179 | 195 - 201 | 234 - 243 | 1 - 128 | 26 - 35 | 50 - 66 | 99 - 117 | DKQYYDILTGDPVEGGMDV (SEQ ID NO: 2889) |
| 1044D09 | 1351 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1044E07 | 1352 | 137 - 247 | 159 - 172 | 188 - 194 | 227 - 236 | 1 - 121 | 26 - 35 | 50 - 66 | 99 - 110 | AGSSLVTYGTDV (SEQ ID NO: 2825) |
| 1044E11 | 1353 | 143 - 253 | 165 - 178 | 194 - 200 | 233 - 242 | 1 - 127 | 26 - 35 | 50 - 66 | 99 - 116 | SDDYDILTGNYVGSLLDY (SEQ ID NO: 2758) |
| 1044F07 | 1354 | 147 - 257 | 169 - 182 | 198 - 204 | 237 - 246 | 1 - 131 | 26 - 35 | 50 - 66 | 99 - 120 | DGRLSYDILTGYYARDYYGMDV (SEQ ID NO: 2912) |
| 1044G02 | 1355 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1044G07 | 1356 | 149 - 259 | 171 - 184 | 200 - 206 | 239 - 248 | 1 - 133 | 26 - 35 | 50 - 66 | 99 - 122 | DQNHPIYDILTGYYVPTGPLELKN (SEQ ID NO: 2845) |
| 1044H01 | 1357 | 144 - 251 | 165 - 175 | 191 - 197 | 230 - 240 | 1 - 128 | 26 - 35 | 50 - 66 | 99 - 117 | EVRNYDLLTRSYLAGPLDN (SEQ ID NO: 2751) |
| 1050A01 | 1358 | 142 - 253 | 164 - 177 | 193 - 199 | 232 - 242 | 1 - 125 | 26 - 35 | 50 - 66 | 99 - 114 | DMGYDILTGYYGAFDI (SEQ ID NO: 2946) |
| 1050B12 | 1359 | 142 - 253 | 164 - 177 | 193 - 199 | 232 - 242 | 1 - 125 | 26 - 35 | 50 - 66 | 99 - 114 | DYYDVLTGFSLDGMDV (SEQ ID NO: 2829) |
| 1050C06 | 1360 | 142 - 248 | 165 - 175 | 191 - 197 | 230 - 237 | 1 - 124 | 26 - 35 | 50 - 65 | 98 - 113 | DHYDVLTGSYLQAFDV (SEQ ID NO: 2728) |
| 1050C08 | 1361 | 142 - 253 | 164 - 177 | 193 - 199 | 232 - 242 | 1 - 125 | 26 - 37 | 52 - 67 | 100 - 114 | GRYDFLTGYLRNFDY (SEQ ID NO: 2731) |
| 1050E01 | 1362 | 141 - 252 | 163 - 176 | 192 - 198 | 231 - 241 | 1 - 124 | 26 - 35 | 50 - 66 | 99 - 113 | GHYDILTGYYFGFDY (SEQ ID NO: 2886) |
| 1050E10 | 1363 | 138 - 248 | 160 - 172 | 188 - 194 | 227 - 237 | 1 - 121 | 26 - 35 | 50 - 66 | 99 - 110 | DMKYYYKYALDV (SEQ ID NO: 2823) |
| 1050H08 | 1364 | 142 - 253 | 164 - 177 | 193 - 199 | 232 - 242 | 1 - 125 | 26 - 35 | 50 - 66 | 99 - 114 | DLRYDILTGYHDAFDI (SEQ ID NO: 2890) |
| 1051A04 | 1365 | 148 - 258 | 170 - 183 | 199 - 205 | 238 - 247 | 1 - 131 | 26 - 35 | 50 - 66 | 99 - 120 | SSPFKWYDALTGHSSYHSAMDV (SEQ ID NO: 2159) |
| 1051A08 | 1366 | 142 - 252 | 164 - 176 | 192 - 198 | 231 - 241 | 1 - 125 | 26 - 35 | 50 - 66 | 99 - 114 | HRRARVVVPVPGAMDV (SEQ ID NO: 2930) |
| 1051A12 | 1367 | 143 - 250 | 164 - 174 | 190 - 196 | 229 - 239 | 1 - 127 | 26 - 35 | 50 - 66 | 99 - 116 | DGSYDILTGYYIDNYMDV (SEQ ID NO: 2154) |
| 1051B08 | 1368 | 143 - 253 | 165 - 177 | 193 - 199 | 232 - 242 | 1 - 126 | 26 - 36 | 51 - 67 | 100 - 115 | RSMIVVTTAPYDAFDL (SEQ ID NO: 2785) |
| 1051C06 | 1369 | 136 - 246 | 158 - 170 | 186 - 192 | 225 - 235 | 1 - 119 | 26 - 35 | 50 - 66 | 99 - 108 | DTVRSGGMDV (SEQ ID NO: 2804) |
| 1051G12 | 1370 | 143 - 250 | 164 - 174 | 190 - 196 | 229 - 239 | 1 - 127 | 26 - 35 | 50 - 66 | 99 - 116 | DGSYDILTGYYIDNYMDV (SEQ ID NO: 2154) |
| 1055A05 | 1371 | 134 - 244 | 156 - 169 | 185 - 191 | 224 - 233 | 1 - 117 | 26 - 35 | 50 - 66 | 99 - 106 | SGPGWFDP (SEQ ID NO: 2870) |
| 1055A11 | 1372 | 134 - 244 | 156 - 169 | 185 - 191 | 224 - 233 | 1 - 117 | 26 - 35 | 50 - 66 | 99 - 106 | SGPGWFDP (SEQ ID NO: 2870) |
| 1061A03 | 1373 | 141 - 251 | 163 - 176 | 192 - 198 | 231 - 240 | 1 - 124 | 26 - 34 | 49 - 65 | 98 - 113 | ELGSSIVGATTGALDM (SEQ ID NO: 2852) |
| 1061A04 | 1374 | 143 - 251 | 165 - 175 | 191 - 197 | 230 - 240 | 1 - 125 | 26 - 35 | 50 - 66 | 99 - 114 | GDYDILTGYPAECFQI (SEQ ID NO: 2854) |
| 1061A08 | 1375 | 142 - 253 | 164 - 176 | 192 - 198 | 233 - 242 | 1 - 124 | 26 - 35 | 50 - 66 | 99 - 113 | DNYDILTGYSRRFDP (SEQ ID NO: 2942) |
| 1061A09 | 1376 | 142 - 252 | 164 - 176 | 192 - 198 | 231 - 241 | 1 - 124 | 26 - 34 | 49 - 65 | 98 - 113 | ELGLSIVGATTGALDM (SEQ ID NO: 2174) |
| 1061A10 | 1377 | 141 - 249 | 163 - 173 | 189 - 195 | 228 - 238 | 1 - 124 | 26 - 34 | 49 - 65 | 98 - 113 | ELGLSIVGATTGALDM (SEQ ID NO: 2174) |
| 1061B07 | 1378 | 141 - 252 | 163 - 176 | 192 - 198 | 231 - 241 | 1 - 124 | 26 - 34 | 49 - 65 | 98 - 113 | ELGLSIVGATTGALDM (SEQ ID NO: 2174) |
| 1061B09 | 1379 | 143 - 253 | 165 - 178 | 194 - 200 | 233 - 242 | 1 - 127 | 24 - 33 | 48 - 64 | 97 - 116 | EGGNYDILTGYYIGNGAFDI (SEQ ID NO: 2158) |

| | | | | | | | | | | |
|---|---|---|---|---|---|---|---|---|---|---|
| 1061B12 | 1380 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1061C12 | 1381 | 138 - 248 | 160 - 173 | 189 - 195 | 228 - 237 | 1 - 122 | 26 - 35 | 50 - 66 | 99 - 111 | TYYDILTGYHFDY (SEQ ID NO: 2788) |
| 1061D01 | 1382 | 137 - 247 | 159 - 172 | 188 - 194 | 227 - 236 | 1 - 121 | 26 - 35 | 50 - 68 | 101 - 110 | GFGVIGNYDY (SEQ ID NO: 2749) |
| 1061D03 | 1383 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1061D04 | 1384 | 140 - 247 | 161 - 171 | 187 - 193 | 226 - 236 | 1 - 124 | 26 - 35 | 50 - 66 | 99 - 113 | AVLRYSAGLQGAFDI (SEQ ID NO: 2970) |
| 1061D07 | 1385 | 141 - 248 | 164 - 174 | 190 - 196 | 229 - 237 | 1 - 125 | 26 - 35 | 50 - 66 | 99 - 114 | VSGYNSGYFESYDMDV (SEQ ID NO: 2732) |
| 1061D09 | 1386 | 141 - 248 | 162 - 172 | 188 - 194 | 227 - 237 | 1 - 125 | 26 - 35 | 50 - 66 | 99 - 114 | LNLEKTVVRGFGYFDL (SEQ ID NO: 2952) |
| 1061D10 | 1387 | 141 - 248 | 162 - 172 | 188 - 194 | 227 - 237 | 1 - 125 | 26 - 35 | 50 - 66 | 99 - 114 | DHYDILTGLYYYGMDV (SEQ ID NO: 2760) |
| 1061E01 | 1388 | 141 - 248 | 162 - 172 | 188 - 194 | 227 - 237 | 1 - 125 | 26 - 35 | 50 - 66 | 99 - 114 | LNLEKTVVRGFGYFDL (SEQ ID NO: 2952) |
| 1061E05 | 1389 | 142 - 251 | 163 - 175 | 191 - 197 | 230 - 240 | 1 - 126 | 26 - 35 | 50 - 66 | 99 - 115 | GGELVWFGESDYYGMDV (SEQ ID NO: 2787) |
| 1061E09 | 1390 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1061E12 | 1391 | 133 - 240 | 154 - 164 | 180 - 186 | 219 - 229 | 1 - 117 | 26 - 35 | 50 - 66 | 99 - 106 | SQRLFIDS (SEQ ID NO: 2842) |
| 1061F01 | 1392 | 146 - 256 | 168 - 181 | 197 - 203 | 236 - 245 | 1 - 130 | 26 - 35 | 50 - 66 | 99 - 119 | DRYYDILTGYYIFGLDDAFDI (SEQ ID NO: 2887) |
| 1061F09 | 1393 | 139 - 246 | 160 - 170 | 186 - 192 | 225 - 235 | 1 - 123 | 26 - 35 | 50 - 66 | 99 - 112 | DSDARLAALDAFDI (SEQ ID NO: 2978) |
| 1061F10 | 1394 | 145 - 252 | 166 - 176 | 192 - 198 | 231 - 241 | 1 - 129 | 26 - 35 | 50 - 66 | 99 - 118 | EESYYDILTGYYVHYYGMDV (SEQ ID NO: 2743) |
| 1061F11 | 1395 | 141 - 251 | 163 - 176 | 192 - 198 | 231 - 240 | 1 - 125 | 26 - 35 | 50 - 66 | 99 - 114 | ATYDPLTGYYFDGFDI (SEQ ID NO: 2949) |
| 1061G01 | 1396 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1061G03 | 1397 | 141 - 251 | 163 - 176 | 192 - 198 | 231 - 240 | 1 - 125 | 26 - 35 | 50 - 66 | 99 - 114 | AYYDILTGFLPYDMDL (SEQ ID NO: 2771) |
| 1061G09 | 1398 | 144 - 254 | 166 - 179 | 195 - 201 | 234 - 243 | 1 - 128 | 26 - 35 | 50 - 65 | 99 - 117 | EVRNYDLLTRSYLAGPLDN (SEQ ID NO: 2751) |
| 1061G10 | 1399 | 143 - 253 | 165 - 178 | 194 - 200 | 233 - 242 | 1 - 127 | 26 - 35 | 50 - 65 | 98 - 116 | EGSYDILTGYYVGVGRMDV (SEQ ID NO: 2171) |
| 1061G11 | 1400 | 137 - 247 | 159 - 171 | 187 - 193 | 226 - 236 | 1 - 121 | 26 - 35 | 50 - 68 | 101 - 110 | RDILTGFYDS (SEQ ID NO: 2933) |
| 1061H05 | 1401 | 142 - 252 | 164 - 177 | 193 - 199 | 232 - 241 | 1 - 126 | 26 - 37 | 52 - 67 | 100 - 115 | ATYDPLTGYSFDGFDI (SEQ ID NO: 2153) |
| 1064A05 | 1402 | 142 - 249 | 163 - 173 | 189 - 195 | 228 - 238 | 1 - 126 | 26 - 35 | 50 - 68 | 101 - 115 | DFYDILTGYQHGMDV (SEQ ID NO: 2919) |
| 1064A11 | 1403 | 138 - 248 | 160 - 173 | 189 - 195 | 228 - 237 | 1 - 122 | 26 - 35 | 50 - 66 | 99 - 111 | HSKEYNWNYALDY (SEQ ID NO: 2754) |
| 1064B01 | 1404 | 138 - 248 | 160 - 173 | 189 - 195 | 228 - 237 | 1 - 122 | 26 - 35 | 50 - 66 | 99 - 111 | TRMDVLTRYYSDP (SEQ ID NO: 2750) |
| 1064B02 | 1405 | 144 - 254 | 166 - 179 | 195 - 201 | 234 - 243 | 1 - 128 | 26 - 35 | 50 - 66 | 99 - 117 | AFEDYDILTGYYHHDAFDI (SEQ ID NO: 2911) |
| 1064B12 | 1406 | 133 - 243 | 155 - 168 | 184 - 190 | 223 - 232 | 1 - 117 | 26 - 35 | 50 - 66 | 99 - 106 | PSYHYMDV (SEQ ID NO: 2740) |
| 1064C06 | 1407 | 145 - 255 | 167 - 180 | 196 - 202 | 235 - 244 | 1 - 129 | 26 - 35 | 50 - 66 | 99 - 118 | VNADYDILTGYFRDYYGMDV (SEQ ID NO: 2819) |
| 1064D01 | 1408 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1064D02 | 1409 | 146 - 256 | 168 - 181 | 197 - 203 | 236 - 245 | 1 - 130 | 26 - 35 | 50 - 66 | 99 - 119 | EDATYYDILTGYYMGSYGMDV (SEQ ID NO: 2763) |
| 1064E01 | 1410 | 143 - 250 | 165 - 176 | 192 - 198 | 231 - 239 | 1 - 127 | 26 - 35 | 50 - 66 | 99 - 116 | ETRKYTSSPFYNYYYMDV (SEQ ID NO: 2736) |
| 1064E02 | 1411 | 140 - 251 | 162 - 174 | 190 - 196 | 229 - 240 | 1 - 124 | 26 - 35 | 50 - 66 | 99 - 113 | RDYDILTGYSRGFDP (SEQ ID NO: 2725) |
| 1064E03 | 1412 | 144 - 254 | 166 - 179 | 195 - 201 | 234 - 243 | 1 - 128 | 26 - 35 | 50 - 66 | 99 - 117 | DGYYDILTTLVSYYNGMDV (SEQ ID NO: 2775) |
| 1064E07 | 1413 | 140 - 250 | 162 - 175 | 191 - 197 | 230 - 239 | 1 - 124 | 26 - 35 | 50 - 65 | 98 - 113 | GERDILTGYYLDGMDV (SEQ ID NO: 2948) |
| 1064E08 | 1414 | 140 - 250 | 162 - 174 | 190 - 196 | 229 - 239 | 1 - 124 | 26 - 35 | 50 - 66 | 99 - 113 | ERGSYSSGYSGAFDV (SEQ ID NO: 2898) |
| 1064F05 | 1415 | 142 - 252 | 164 - 177 | 193 - 199 | 232 - 241 | 1 - 126 | 26 - 35 | 50 - 66 | 99 - 115 | ESGGYSYGSRDYYGMDV (SEQ ID NO: 2836) |
| 1064F08 | 1416 | 145 - 252 | 166 - 176 | 192 - 198 | 231 - 241 | 1 - 129 | 26 - 35 | 50 - 66 | 99 - 118 | DRGVGYDILTGRTYYYGMDV (SEQ ID NO: 2900) |
| 1064G06 | 1417 | 141 - 248 | 162 - 172 | 188 - 194 | 227 - 237 | 1 - 125 | 26 - 35 | 50 - 66 | 99 - 114 | ATYDPLTGYSFDGFDI (SEQ ID NO: 2153) |
| 1065A12 | 1418 | 143 - 253 | 165 - 178 | 194 - 200 | 233 - 242 | 1 - 127 | 26 - 35 | 50 - 66 | 99 - 116 | DVSGHDILTGYSYRYFDV (SEQ ID NO: 2795) |
| 1065C04 | 1419 | 139 - 249 | 161 - 173 | 189 - 195 | 228 - 238 | 1 - 123 | 26 - 35 | 50 - 66 | 99 - 112 | GQKNYYESSGYLEH (SEQ ID NO: 2916) |
| 1065C09 | 1420 | 140 - 250 | 162 - 174 | 190 - 196 | 229 - 239 | 1 - 124 | 26 - 35 | 50 - 66 | 99 - 113 | GDYDILTGYYSHFDY (SEQ ID NO: 2908) |
| 1065E02 | 1421 | 141 - 248 | 164 - 174 | 190 - 196 | 229 - 237 | 1 - 125 | 26 - 35 | 50 - 66 | 99 - 114 | AYDYDILTGYSYYFDY (SEQ ID NO: 2895) |

| | | | | | | | | | | |
|---|---|---|---|---|---|---|---|---|---|---|
| 1065E04 | 1422 | 135 - 245 | 157 - 169 | 185 - 191 | 224 - 234 | 1 - 119 | 26 - 35 | 50 - 66 | 99 - 108 | GMGDHYGMDV (SEQ ID NO: 2161) |
| 1065F03 | 1423 | 137 - 247 | 159 - 172 | 188 - 194 | 227 - 236 | 1 - 121 | 26 - 35 | 50 - 66 | 99 - 110 | AGSSLMTYGTDV (SEQ ID NO: 2773) |
| 1065G06 | 1424 | 135 - 242 | 156 - 166 | 182 - 188 | 221 - 231 | 1 - 119 | 26 - 35 | 50 - 66 | 99 - 108 | GMGDHYGMDV (SEQ ID NO: 2161) |
| 1065G07 | 1425 | 142 - 249 | 163 - 173 | 189 - 195 | 228 - 238 | 1 - 126 | 26 - 35 | 50 - 66 | 99 - 115 | GGNYDILTGYYIGAFDI (SEQ ID NO: 2824) |
| 1065G08 | 1426 | 139 - 246 | 160 - 170 | 186 - 192 | 225 - 235 | 1 - 123 | 26 - 35 | 50 - 66 | 99 - 112 | SRDLLLFPHYGMDV (SEQ ID NO: 2133) |
| 1065H06 | 1427 | 144 - 254 | 166 - 179 | 195 - 201 | 234 - 243 | 1 - 128 | 26 - 35 | 50 - 66 | 99 - 117 | GYEYYDILTGYNELGAFDI (SEQ ID NO: 2851) |
| 1066A03 | 1428 | 144 - 254 | 166 - 179 | 195 - 201 | 234 - 243 | 1 - 128 | 26 - 35 | 50 - 66 | 99 - 117 | DGYYYDILTGYYNQYGMDV (SEQ ID NO: 2915) |
| 1066A08 | 1429 | 137 - 247 | 159 - 171 | 187 - 193 | 226 - 236 | 1 - 121 | 26 - 35 | 50 - 66 | 99 - 110 | AGSSLMTYGTDV (SEQ ID NO: 2773) |
| 1066A09 | 1430 | 135 - 245 | 157 - 169 | 185 - 191 | 224 - 234 | 1 - 119 | 26 - 35 | 50 - 66 | 99 - 108 | GMGDHYGMDV (SEQ ID NO: 2161) |
| 1066A10 | 1431 | 142 - 252 | 164 - 177 | 193 - 199 | 232 - 241 | 1 - 126 | 26 - 35 | 50 - 66 | 99 - 115 | DRGYDILTGYYYYGMDV (SEQ ID NO: 2876) |
| 1066A11 | 1432 | 143 - 253 | 165 - 178 | 194 - 200 | 233 - 242 | 1 - 127 | 26 - 35 | 50 - 66 | 99 - 116 | EVRDYDILTGYYISYMDV (SEQ ID NO: 2778) |
| 1066B02 | 1433 | 135 - 242 | 156 - 166 | 182 - 188 | 221 - 231 | 1 - 119 | 26 - 35 | 50 - 66 | 99 - 108 | GMGDHYGMDV (SEQ ID NO: 2161) |
| 1066B08 | 1434 | 137 - 247 | 159 - 172 | 188 - 194 | 227 - 236 | 1 - 121 | 26 - 35 | 50 - 66 | 99 - 110 | AGSSLMTYGTDV (SEQ ID NO: 2773) |
| 1066B10 | 1435 | 142 - 252 | 164 - 177 | 193 - 199 | 232 - 241 | 1 - 126 | 26 - 35 | 50 - 66 | 99 - 115 | GLYFEDTNYRHGDAFDI (SEQ ID NO: 2790) |
| 1066C02 | 1436 | 135 - 245 | 157 - 169 | 185 - 191 | 224 - 234 | 1 - 119 | 26 - 35 | 50 - 66 | 99 - 108 | GMGDHYGMDV (SEQ ID NO: 2161) |
| 1066C11 | 1437 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1066C12 | 1438 | 135 - 242 | 156 - 166 | 182 - 188 | 221 - 231 | 1 - 119 | 26 - 35 | 50 - 66 | 99 - 108 | GMGDHYGMDV (SEQ ID NO: 2161) |
| 1066D06 | 1439 | 140 - 250 | 162 - 175 | 191 - 197 | 230 - 239 | 1 - 124 | 26 - 35 | 50 - 66 | 99 - 113 | ENYDFLTGYYGAFDI (SEQ ID NO: 2772) |
| 1066D08 | 1440 | 138 - 248 | 160 - 173 | 189 - 195 | 228 - 237 | 1 - 122 | 26 - 35 | 50 - 66 | 99 - 111 | ESKEYNWNYALDY (SEQ ID NO: 2754) |
| 1066D11 | 1441 | 144 - 254 | 166 - 179 | 195 - 201 | 234 - 243 | 1 - 128 | 26 - 35 | 50 - 66 | 99 - 117 | ERSQFDFLTGVDRYHPMDV (SEQ ID NO: 2956) |
| 1066D12 | 1442 | 139 - 249 | 161 - 174 | 190 - 196 | 229 - 238 | 1 - 123 | 26 - 35 | 50 - 66 | 99 - 112 | EGAADYLNGQYFQH (SEQ ID NO: 2815) |
| 1066E06 | 1443 | 137 - 247 | 159 - 171 | 187 - 193 | 226 - 236 | 1 - 121 | 26 - 35 | 50 - 66 | 99 - 110 | AGSSLMTYGTDV (SEQ ID NO: 2773) |
| 1066E12 | 1444 | 135 - 242 | 156 - 166 | 182 - 188 | 221 - 231 | 1 - 119 | 26 - 35 | 50 - 66 | 99 - 108 | GMGDHYGMDV (SEQ ID NO: 2161) |
| 1066G05 | 1445 | 142 - 249 | 163 - 173 | 189 - 195 | 228 - 238 | 1 - 126 | 26 - 35 | 50 - 66 | 99 - 115 | GLYFEDTNYRHGDAFDI (SEQ ID NO: 2790) |
| 1066G08 | 1446 | 141 - 248 | 164 - 174 | 190 - 196 | 229 - 237 | 1 - 125 | 26 - 35 | 50 - 66 | 99 - 114 | VYYDILTGHPTYGMDV (SEQ ID NO: 2791) |
| 1066G10 | 1447 | 144 - 254 | 166 - 178 | 194 - 200 | 233 - 243 | 1 - 128 | 26 - 35 | 50 - 68 | 101 - 117 | GIYDILTGYHWDDAFDI (SEQ ID NO: 2872) |
| 1066G12 | 1448 | 143 - 254 | 165 - 177 | 193 - 199 | 232 - 243 | 1 - 127 | 26 - 35 | 50 - 66 | 99 - 116 | ESTYDILTGSYHDYGLDV (SEQ ID NO: 2822) |
| 1066H04 | 1449 | 143 - 253 | 165 - 178 | 194 - 200 | 233 - 242 | 1 - 127 | 26 - 35 | 50 - 65 | 98 - 116 | DRLHYDILTGHQTDDAFDI (SEQ ID NO: 2885) |
| 1067A07 | 1450 | 144 - 254 | 166 - 179 | 195 - 201 | 234 - 243 | 1 - 128 | 26 - 35 | 50 - 66 | 99 - 117 | VLTNYDILTGYYREDAFDM (SEQ ID NO: 2939) |
| 1067A11 | 1451 | 135 - 245 | 157 - 170 | 186 - 192 | 225 - 234 | 1 - 119 | 26 - 35 | 50 - 66 | 99 - 108 | GMGDHYGMDV (SEQ ID NO: 2161) |
| 1067B08 | 1452 | 149 - 259 | 171 - 184 | 200 - 206 | 239 - 248 | 1 - 133 | 26 - 35 | 50 - 66 | 99 - 122 | DRGASNYDILTGYYAPAQGVAFDI (SEQ ID NO: 2969) |
| 1067C08 | 1453 | 148 - 258 | 170 - 183 | 199 - 205 | 238 - 247 | 1 - 132 | 26 - 37 | 52 - 69 | 102 - 121 | EGAHYDILTGHNYYHYGMDV (SEQ ID NO: 2747) |
| 1067C09 | 1454 | 143 - 253 | 165 - 178 | 194 - 200 | 233 - 242 | 1 - 127 | 26 - 35 | 50 - 66 | 99 - 116 | ETRKYTSSPPYNYYYMDV (SEQ ID NO: 2736) |
| 1067D07 | 1455 | 137 - 247 | 159 - 171 | 187 - 193 | 226 - 236 | 1 - 121 | 26 - 35 | 50 - 66 | 99 - 110 | AGSSLMTYGTDV (SEQ ID NO: 2773) |
| 1067E01 | 1456 | 142 - 248 | 164 - 174 | 190 - 196 | 229 - 238 | 1 - 124 | 26 - 35 | 50 - 66 | 99 - 113 | DQHDILTGVYYGMDV (SEQ ID NO: 2921) |
| 1067E06 | 1457 | 135 - 245 | 157 - 169 | 185 - 191 | 224 - 234 | 1 - 119 | 26 - 35 | 50 - 66 | 99 - 108 | GMGDHYGMDV (SEQ ID NO: 2161) |
| 1067E07 | 1458 | 150 - 260 | 172 - 184 | 200 - 206 | 239 - 249 | 1 - 134 | 26 - 35 | 50 - 67 | 108 - 123 | DYPGSEYDILTGYLFGYYYYGMDV (SEQ ID NO: 2926) |
| 1067E11 | 1459 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1067G03 | 1460 | 140 - 250 | 162 - 175 | 191 - 197 | 230 - 239 | 1 - 124 | 26 - 35 | 50 - 66 | 99 - 113 | ARHVGVLGGKNAFEI (SEQ ID NO: 2765) |
| 1067G05 | 1461 | 140 - 250 | 162 - 174 | 190 - 196 | 229 - 239 | 1 - 124 | 26 - 35 | 50 - 66 | 99 - 113 | DQHDILTGGYYGMDV (SEQ ID NO: 2894) |
| 1067G12 | 1462 | 141 - 252 | 163 - 176 | 192 - 198 | 231 - 241 | 1 - 125 | 26 - 35 | 50 - 66 | 99 - 114 | ATYDPLTGYSFDGFDI (SEQ ID NO: 2153) |
| 1067H05 | 1463 | 146 - 256 | 168 - 180 | 196 - 202 | 235 - 245 | 1 - 130 | 26 - 35 | 50 - 68 | 101 - 119 | EGTYYDILTGYYPLGYFDY (SEQ ID NO: 2936) |

| | | | | | | | | | | |
|---|---|---|---|---|---|---|---|---|---|---|
| 1067H06 | 1464 | 135 - 245 | 157 - 169 | 185 - 191 | 224 - 234 | 1 - 119 | 26 - 35 | 50 - 66 | 99 - 108 | GMGDHYGMDV (SEQ ID NO: 2161) |
| 1068C09 | 1465 | 138 - 248 | 160 - 172 | 188 - 194 | 227 - 237 | 1 - 121 | 26 - 35 | 50 - 66 | 99 - 110 | GGSSQNFYGMDV (SEQ ID NO: 2884) |
| 1068G03 | 1466 | 144 - 254 | 166 - 178 | 194 - 200 | 233 - 243 | 1 - 127 | 26 - 35 | 50 - 66 | 99 - 116 | GTGYDILTGYYMGSAFDQ (SEQ ID NO: 2800) |
| 1068G04 | 1467 | 143 - 252 | 165 - 178 | 194 - 200 | 233 - 241 | 1 - 126 | 26 - 35 | 50 - 66 | 99 - 115 | GVVWVAYGDVGIYGFDV (SEQ ID NO: 2937) |
| 1068G07 | 1468 | 142 - 251 | 164 - 174 | 190 - 196 | 229 - 240 | 1 - 124 | 26 - 35 | 50 - 66 | 99 - 113 | HDYYIMTAAHYYYDS (SEQ ID NO: 2909) |
| 1068G08 | 1469 | 144 - 254 | 166 - 178 | 194 - 200 | 233 - 243 | 1 - 127 | 26 - 35 | 50 - 66 | 99 - 116 | GIGYDLLTGYFTGSPLDY (SEQ ID NO: 2846) |
| 1070F07 | 1470 | 140 - 247 | 161 - 171 | 187 - 193 | 226 - 236 | 1 - 124 | 26 - 35 | 50 - 66 | 99 - 113 | DFYDILTGYHDAFDI (SEQ ID NO: 2910) |
| 1070G05 | 1471 | 140 - 250 | 162 - 175 | 191 - 197 | 230 - 239 | 1 - 124 | 26 - 35 | 50 - 68 | 101 - 113 | DVDDILTGYSWDY (SEQ ID NO: 2867) |
| 1070H02 | 1472 | 141 - 248 | 162 - 172 | 188 - 194 | 227 - 237 | 1 - 125 | 26 - 35 | 50 - 66 | 99 - 114 | MEYDILTGYYGGYFDY (SEQ ID NO: 2179) |
| 1071A01 | 1473 | 141 - 251 | 163 - 176 | 192 - 198 | 231 - 240 | 1 - 125 | 26 - 35 | 50 - 66 | 99 - 114 | AAYDPLTGYSFDGFDI (SEQ ID NO: 2783) |
| 1071A03 | 1474 | 143 - 250 | 164 - 174 | 190 - 196 | 229 - 239 | 1 - 127 | 26 - 35 | 50 - 66 | 99 - 116 | DMHYDILTGYYTGLAFDM (SEQ ID NO: 2917) |
| 1071B08 | 1475 | 144 - 252 | 166 - 176 | 192 - 198 | 231 - 241 | 1 - 126 | 27 - 36 | 51 - 67 | 100 - 115 | GGYDILIQYPAEFFHP (SEQ ID NO: 2764) |
| 1071E01 | 1476 | 138 - 248 | 160 - 173 | 189 - 195 | 228 - 237 | 1 - 122 | 26 - 35 | 50 - 66 | 99 - 111 | DFGVIGDYRPFDY (SEQ ID NO: 2777) |
| 1071F11 | 1477 | 135 - 245 | 157 - 169 | 185 - 191 | 224 - 234 | 1 - 119 | 26 - 35 | 50 - 66 | 99 - 108 | SSNPVYGLDV (SEQ ID NO: 2957) |
| 1071G11 | 1478 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1071H08 | 1479 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1074A02 | 1480 | 142 - 250 | 164 - 174 | 190 - 196 | 229 - 239 | 1 - 125 | 26 - 35 | 50 - 66 | 99 - 114 | DDRDILTNYYLEYFQH (SEQ ID NO: 2868) |
| 1074A08 | 1481 | 148 - 259 | 170 - 182 | 198 - 204 | 237 - 248 | 1 - 131 | 26 - 35 | 50 - 66 | 99 - 120 | SSPPKWYDALTGDSSYHSAMDV (SEQ ID NO: 2165) |
| 1074D10 | 1482 | 146 - 253 | 168 - 178 | 194 - 200 | 233 - 242 | 1 - 128 | 26 - 35 | 50 - 66 | 99 - 117 | DKTLGDQLVEAYYYDGMDV (SEQ ID NO: 2776) |
| 1074E01 | 1483 | 146 - 255 | 168 - 178 | 194 - 200 | 233 - 244 | 1 - 128 | 26 - 35 | 50 - 66 | 99 - 117 | LGRTSRDLLTGYHFYNMDV (SEQ ID NO: 2944) |
| 1074E02 | 1484 | 142 - 250 | 164 - 174 | 190 - 196 | 229 - 239 | 1 - 124 | 26 - 35 | 50 - 66 | 99 - 113 | DDYDILTGSLYYFDS (SEQ ID NO: 2803) |
| 1074E08 | 1485 | 144 - 259 | 166 - 179 | 195 - 205 | 240 - 248 | 1 - 127 | 26 - 35 | 50 - 66 | 99 - 116 | GTGYDILTGYYMGSAFDQ (SEQ ID NO: 2800) |
| 1074F12 | 1486 | 142 - 250 | 164 - 174 | 190 - 196 | 229 - 239 | 1 - 124 | 26 - 35 | 50 - 66 | 99 - 113 | DRADILTGYNDAFDI (SEQ ID NO: 2739) |
| 1074H05 | 1487 | 140 - 251 | 162 - 175 | 191 - 197 | 230 - 240 | 1 - 123 | 26 - 35 | 50 - 66 | 99 - 112 | RYGDPFYYYYYMNV (SEQ ID NO: 2755) |
| 1074H07 | 1488 | 145 - 253 | 167 - 177 | 193 - 199 | 232 - 242 | 1 - 127 | 26 - 35 | 50 - 66 | 99 - 116 | GTGYDILTGYYMGSAFDQ (SEQ ID NO: 2800) |
| 1074H08 | 1489 | 143 - 254 | 165 - 178 | 194 - 200 | 233 - 243 | 1 - 126 | 26 - 35 | 50 - 66 | 99 - 115 | VSNDILTGWGGYNWFDP (SEQ ID NO: 2955) |
| 1075A07 | 1490 | 145 - 253 | 167 - 177 | 193 - 199 | 232 - 242 | 1 - 127 | 26 - 35 | 50 - 66 | 99 - 116 | GTGYDILTGYYMGSAFDQ (SEQ ID NO: 2800) |
| 1075B01 | 1491 | 134 - 244 | 156 - 168 | 184 - 190 | 223 - 233 | 1 - 117 | 26 - 35 | 50 - 66 | 99 - 106 | DQGRYLDL (SEQ ID NO: 2175) |
| 1075B04 | 1492 | 134 - 247 | 156 - 169 | 185 - 191 | 224 - 236 | 1 - 117 | 26 - 35 | 50 - 66 | 99 - 106 | DQGRYLDL (SEQ ID NO: 2175) |
| 1075B06 | 1493 | 141 - 252 | 163 - 175 | 191 - 197 | 230 - 241 | 1 - 124 | 26 - 34 | 49 - 65 | 98 - 113 | ELGLSIVGATTGALDM (SEQ ID NO: 2174) |
| 1075B08 | 1494 | 144 - 257 | 166 - 179 | 195 - 201 | 234 - 246 | 1 - 127 | 26 - 35 | 50 - 66 | 99 - 116 | GTGYDILTGYYMGSAFDQ (SEQ ID NO: 2800) |
| 1075B09 | 1495 | 142 - 252 | 164 - 176 | 192 - 198 | 231 - 241 | 1 - 125 | 26 - 35 | 50 - 66 | 99 - 114 | TYYDILTGYYAEYFQH (SEQ ID NO: 2932) |
| 1075B12 | 1496 | 141 - 251 | 163 - 176 | 192 - 198 | 231 - 240 | 1 - 124 | 26 - 35 | 50 - 66 | 99 - 113 | SDYDILTGYYWVPAY (SEQ ID NO: 2812) |
| 1075C01 | 1497 | 148 - 259 | 170 - 183 | 199 - 205 | 238 - 248 | 1 - 131 | 26 - 35 | 50 - 66 | 99 - 120 | GREDTDKVKPWDRYFHYYYMDV (SEQ ID NO: 2835) |
| 1075C05 | 1498 | 134 - 244 | 156 - 168 | 184 - 190 | 223 - 233 | 1 - 117 | 26 - 35 | 50 - 66 | 99 - 106 | DQGKYLDL (SEQ ID NO: 2175) |
| 1075D05 | 1499 | 145 - 253 | 168 - 179 | 195 - 201 | 234 - 242 | 1 - 127 | 26 - 35 | 50 - 66 | 99 - 116 | GTGYDILTGYYMGSVFDP (SEQ ID NO: 2897) |
| 1075D07 | 1500 | 142 - 252 | 164 - 176 | 192 - 198 | 231 - 241 | 1 - 125 | 26 - 35 | 50 - 66 | 99 - 114 | SYYDILTGYYHTPLDY (SEQ ID NO: 2853) |
| 1075D08 | 1501 | 141 - 251 | 163 - 175 | 191 - 197 | 230 - 240 | 1 - 124 | 26 - 34 | 49 - 65 | 98 - 113 | ELGLSIVGATTGALDM (SEQ ID NO: 2174) |
| 1075E01 | 1502 | 145 - 253 | 167 - 177 | 193 - 199 | 232 - 242 | 1 - 127 | 26 - 35 | 50 - 66 | 99 - 116 | GTGYDILTGYYMGSAFDQ (SEQ ID NO: 2800) |
| 1075E03 | 1503 | 150 - 261 | 172 - 184 | 200 - 206 | 239 - 250 | 1 - 132 | 28 - 37 | 52 - 68 | 101 - 121 | GGGYDILTGYSYPYLYYGLDV (SEQ ID NO: 2865) |
| 1075E04 | 1504 | 144 - 255 | 166 - 179 | 195 - 201 | 234 - 244 | 1 - 127 | 26 - 35 | 50 - 66 | 99 - 116 | GRGYDVLTGYFTGSPLDY (SEQ ID NO: 2881) |
| 1075E05 | 1505 | 141 - 252 | 163 - 176 | 192 - 198 | 231 - 241 | 1 - 124 | 26 - 34 | 49 - 65 | 98 - 113 | ELGLSIVGATTGALDM (SEQ ID NO: 2174) |

| | | | | | | | | | |
|---|---|---|---|---|---|---|---|---|---|
| 1075E10 | 1506 | 141 - 252 | 163 - 176 | 192 - 198 | 231 - 241 | 1 - 124 | 26 - 34 | 49 - 65 | 98 - 113 | ELGLSIVGATTGALDM (SEQ ID NO: 2174) |
| 1075E11 | 1507 | 134 - 244 | 156 - 168 | 184 - 190 | 223 - 233 | 1 - 117 | 26 - 35 | 50 - 66 | 99 - 106 | SGPGWFDP (SEQ ID NO: 2870) |
| 1075E12 | 1508 | 143 - 254 | 165 - 178 | 194 - 200 | 233 - 243 | 1 - 126 | 26 - 35 | 50 - 66 | 99 - 115 | TDRFGAKDVTARWGMDV (SEQ ID NO: 2979) |
| 1075F02 | 1509 | 146 - 253 | 168 - 178 | 194 - 200 | 233 - 242 | 1 - 128 | 26 - 35 | 50 - 66 | 99 - 117 | EQGYDILTGYYPEGGWFDP (SEQ ID NO: 2834) |
| 1075F04 | 1510 | 142 - 251 | 164 - 176 | 192 - 198 | 231 - 240 | 1 - 125 | 26 - 37 | 52 - 67 | 100 - 114 | AGYDLLTGYPFYFDS (SEQ ID NO: 2757) |
| 1075F06 | 1511 | 146 - 254 | 168 - 178 | 194 - 200 | 233 - 243 | 1 - 128 | 26 - 35 | 50 - 66 | 99 - 117 | GRNYYDFLTGYNFNLGLDY (SEQ ID NO: 2830) |
| 1075F07 | 1512 | 141 - 251 | 163 - 175 | 191 - 197 | 230 - 240 | 1 - 124 | 26 - 35 | 50 - 66 | 99 - 113 | ENYDSLTGYYNYFDY (SEQ ID NO: 2971) |
| 1075F08 | 1513 | 134 - 244 | 156 - 168 | 184 - 190 | 223 - 233 | 1 - 117 | 26 - 35 | 50 - 66 | 99 - 106 | DQRKAQDI (SEQ ID NO: 2779) |
| 1075F09 | 1514 | 147 - 257 | 169 - 181 | 197 - 203 | 236 - 246 | 1 - 129 | 26 - 35 | 50 - 66 | 99 - 118 | LKAPYYDLLTGYHLPKWFDT (SEQ ID NO: 2953) |
| 1075F10 | 1515 | 135 - 243 | 157 - 167 | 183 - 189 | 222 - 232 | 1 - 117 | 26 - 35 | 50 - 66 | 99 - 106 | DQGRYLDL (SEQ ID NO: 2175) |
| 1075F11 | 1516 | 134 - 245 | 156 - 169 | 185 - 191 | 224 - 234 | 1 - 117 | 26 - 35 | 50 - 66 | 99 - 106, | DQGRYLDL (SEQ ID NO: 2175) |
| 1075G05 | 1517 | 141 - 252 | 163 - 175 | 191 - 197 | 230 - 241 | 1 - 124 | 26 - 34 | 49 - 65 | 98 - 113 | ELGLSIVGATTGALDM (SEQ ID NO: 2174) |
| 1075G07 | 1518 | 141 - 252 | 163 - 175 | 191 - 197 | 230 - 241 | 1 - 124 | 26 - 35 | 50 - 66 | 99 - 113 | GRYYDMLTRGGYFDY (SEQ ID NO: 2858) |
| 1075G08 | 1519 | 141 - 252 | 163 - 176 | 192 - 198 | 231 - 241 | 1 - 124 | 26 - 35 | 50 - 66 | 99 - 113 | RQYDILTGYYGGFDY (SEQ ID NO: 2958) |
| 1075G11 | 1520 | 142 - 253 | 164 - 177 | 193 - 199 | 232 - 242 | 1 - 125 | 26 - 35 | 50 - 66 | 99 - 114 | TDYDILTGYPMGYFDP (SEQ ID NO: 2173) |
| 1075G12 | 1521 | 134 - 245 | 156 - 169 | 185 - 191 | 224 - 234 | 1 - 117 | 26 - 35 | 50 - 66 | 99 - 106 | DQGRYLDL (SEQ ID NO: 2175) |
| 1075H02 | 1522 | 144 - 254 | 166 - 178 | 194 - 200 | 233 - 243 | 1 - 127 | 26 - 35 | 50 - 66 | 99 - 116 | GTGYDILTGYYMGSAFDQ (SEQ ID NO: 2800) |
| 1075H03 | 1523 | 134 - 245 | 156 - 169 | 185 - 191 | 224 - 234 | 1 - 117 | 26 - 35 | 50 - 66 | 99 - 106 | DQGRYLDL (SEQ ID NO: 2175) |
| 1075H06 | 1524 | 134 - 244 | 156 - 168 | 184 - 190 | 223 - 233 | 1 - 117 | 26 - 35 | 50 - 66 | 99 - 106 | DQGRYLDL (SEQ ID NO: 2175) |
| 1075H08 | 1525 | 144 - 254 | 166 - 179 | 195 - 201 | 234 - 243 | 1 - 127 | 26 - 35 | 50 - 66 | 99 - 116 | GSGYDLLTGYFTGSPLDY (SEQ ID NO: 2766) |
| 1076A01 | 1526 | 144 - 253 | 166 - 176 | 192 - 198 | 231 - 242 | 1 - 126 | 26 - 35 | 50 - 66 | 99 - 115 | DRRRDDLTGYLYDAFDS (SEQ ID NO: 2878) |
| 1076A03 | 1527 | 137 - 247 | 159 - 171 | 187 - 193 | 226 - 236 | 1 - 119 | 26 - 35 | 50 - 68 | 101 - 108 | GYDTAMQY (SEQ ID NO: 2951) |
| 1076A06 | 1528 | 134 - 245 | 156 - 168 | 184 - 190 | 223 - 234 | 1 - 117 | 26 - 35 | 50 - 66 | 99 - 106 | DQGRYLDL (SEQ ID NO: 2175) |
| 1076A07 | 1529 | 140 - 250 | 162 - 174 | 190 - 196 | 229 - 239 | 1 - 123 | 26 - 35 | 50 - 66 | 99 - 112 | DRRDILTGSNFGQD (SEQ ID NO: 2913) |
| 1076A08 | 1530 | 144 - 253 | 166 - 176 | 192 - 198 | 231 - 242 | 1 - 126 | 26 - 35 | 50 - 66 | 99 - 115 | MGHYDILTGYRHYGMDV (SEQ ID NO: 2831) |
| 1076B01 | 1531 | 145 - 257 | 167 - 179 | 195 - 201 | 236 - 246 | 1 - 127 | 26 - 35 | 50 - 66 | 99 - 116 | GSGYDLLTGYFTGSPLDY (SEQ ID NO: 2766) |
| 1076B03 | 1532 | 134 - 245 | 156 - 169 | 185 - 191 | 224 - 234 | 1 - 117 | 26 - 35 | 50 - 66 | 99 - 106 | DQGRYLDL (SEQ ID NO: 2175) |
| 1076B07 | 1533 | 135 - 243 | 157 - 167 | 183 - 189 | 222 - 232 | 1 - 117 | 26 - 35 | 50 - 66 | 99 - 106 | DQGRYLDL (SEQ ID NO: 2175) |
| 1076B08 | 1534 | 143 - 252 | 166 - 177 | 193 - 199 | 232 - 241 | 1 - 125 | 26 - 35 | 50 - 66 | 99 - 114 | PYYDPLTAYTFQYFGN (SEQ ID NO: 2806) |
| 1076C04 | 1535 | 142 - 250 | 164 - 174 | 190 - 196 | 229 - 239 | 1 - 124 | 26 - 34 | 49 - 65 | 98 - 113 | ELGLSIVGATTGALDM (SEQ ID NO: 2174) |
| 1076C10 | 1536 | 141 - 251 | 163 - 175 | 191 - 197 | 230 - 240 | 1 - 124 | 26 - 35 | 50 - 66 | 99 - 113 | GRYYDMLTRGGYFDY (SEQ ID NO: 2858) |
| 1076D01 | 1537 | 142 - 252 | 164 - 176 | 192 - 198 | 231 - 241 | 1 - 125 | 26 - 35 | 50 - 66 | 99 - 114 | LDYDILTGYYPSGFDY (SEQ ID NO: 2799) |
| 1076D08 | 1538 | 141 - 251 | 163 - 175 | 191 - 197 | 230 - 240 | 1 - 124 | 26 - 37 | 52 - 67 | 100 - 113 | RFYDLLTGYSAFDS (SEQ ID NO: 2756) |
| 1076D11 | 1539 | 144 - 255 | 166 - 179 | 195 - 201 | 234 - 244 | 1 - 127 | 26 - 35 | 50 - 66 | 99 - 116 | GTGYDILTGYYMGSAFDQ (SEQ ID NO: 2800) |
| 1076D12 | 1540 | 142 - 250 | 164 - 174 | 190 - 196 | 229 - 239 | 1 - 124 | 26 - 34 | 49 - 65 | 98 - 113 | ELGLSIVGATTGALDM (SEQ ID NO: 2174) |
| 1076E04 | 1541 | 145 - 252 | 167 - 177 | 193 - 199 | 232 - 241 | 1 - 127 | 26 - 35 | 50 - 66 | 99 - 116 | GTGYDILTGYYMGSAFDQ (SEQ ID NO: 2800) |
| 1076E07 | 1542 | 141 - 251 | 163 - 175 | 191 - 197 | 230 - 240 | 1 - 124 | 26 - 35 | 50 - 66 | 99 - 113 | EYYDVLTGLFYYMDV (SEQ ID NO: 2841) |
| 1076E09 | 1543 | 142 - 253 | 164 - 177 | 193 - 199 | 232 - 242 | 1 - 125 | 26 - 35 | 50 - 66 | 99 - 114 | DDRDILTNYYLEYFQH (SEQ ID NO: 2868) |
| 1076E11 | 1544 | 144 - 254 | 166 - 179 | 195 - 201 | 234 - 243 | 1 - 127 | 26 - 35 | 50 - 66 | 99 - 116 | GTGYDILTGYYMGSAFDQ (SEQ ID NO: 2800) |
| 1076F01 | 1545 | 144 - 253 | 166 - 178 | 194 - 199 | 232 - 242 | 1 - 127 | 26 - 35 | 50 - 66 | 99 - 116 | GTGYDILTGYYMGSAFDQ (SEQ ID NO: 2800) |
| 1076F03 | 1546 | 141 - 251 | 163 - 175 | 191 - 197 | 230 - 240 | 1 - 124 | 26 - 36 | 51 - 66 | 99 - 113 | GDYDVLTGYLRKLDY (SEQ ID NO: 2742) |
| 1076F04 | 1547 | 135 - 245 | 157 - 169 | 185 - 191 | 224 - 234 | 1 - 117 | 26 - 35 | 50 - 66 | 99 - 106 | DQGRYLDL (SEQ ID NO: 2175) |

| | | | | | | | | | | |
|---|---|---|---|---|---|---|---|---|---|---|
| 1076F08 | 1548 | 142 - 250 | 164 - 174 | 190 - 196 | 229 - 239 | 1 - 124 | 26 - 36 | 51 - 66 | 99 - 113 | VHYDILTGYLWAFDI (SEQ ID NO: 2730) |
| 1076F10 | 1549 | 141 - 252 | 163 - 175 | 191 - 197 | 230 - 241 | 1 - 124 | 26 - 34 | 49 - 65 | 98 - 113 | ELGLSIVGATTGALDM (SEQ ID NO: 2174) |
| 1076G09 | 1550 | 134 - 245 | 156 - 168 | 184 - 190 | 223 - 234 | 1 - 117 | 26 - 35 | 50 - 66 | 99 - 106 | DQGRYLDL (SEQ ID NO: 2175) |
| 1076G10 | 1551 | 141 - 251 | 163 - 175 | 191 - 197 | 230 - 240 | 1 - 124 | 26 - 35 | 50 - 66 | 99 - 113 | GRYYDMLTRGGYFDY (SEQ ID NO: 2858) |
| 1076G11 | 1552 | 144 - 259 | 166 - 179 | 195 - 205 | 240 - 248 | 1 - 127 | 26 - 35 | 50 - 66 | 99 - 116 | GTGYDILTGYYMGSAFDQ (SEQ ID NO: 2809) |
| 1076G12 | 1553 | 147 - 257 | 169 - 181 | 197 - 203 | 236 - 246 | 1 - 130 | 26 - 35 | 50 - 65 | 99 - 119 | NGYYDILTGYYLWDYYYGMDV (SEQ ID NO: 2769) |
| 1076H02 | 1554 | 141 - 251 | 163 - 175 | 191 - 197 | 230 - 240 | 1 - 124 | 26 - 35 | 50 - 66 | 99 - 113 | ENYDSLTGYYNYFDY (SEQ ID NO: 2971) |
| 1076H04 | 1555 | 143 - 251 | 165 - 175 | 191 - 197 | 230 - 240 | 1 - 125 | 26 - 35 | 50 - 65 | 99 - 114 | THYDILTGYYSHPLDY (SEQ ID NO: 2863) |
| 1076H05 | 1556 | 141 - 251 | 163 - 175 | 191 - 197 | 230 - 240 | 1 - 124 | 26 - 34 | 49 - 65 | 98 - 113 | ELGLSIVGATTGALDM (SEQ ID NO: 2174) |
| 1076H06 | 1557 | 141 - 252 | 163 - 176 | 192 - 198 | 231 - 241 | 1 - 124 | 26 - 35 | 50 - 66 | 99 - 113 | VPYDILTGYWGAFDV (SEQ ID NO: 2827) |
| 1076H09 | 1558 | 144 - 256 | 166 - 179 | 195 - 201 | 234 - 245 | 1 - 127 | 26 - 35 | 50 - 66 | 99 - 116 | GSGYDLLTGYFTGSPLDY (SEQ ID NO: 2766) |
| 1076H10 | 1559 | 144 - 256 | 166 - 179 | 195 - 201 | 234 - 245 | 1 - 127 | 26 - 35 | 50 - 66 | 99 - 116 | GSGYDLLTGYFTGSPLDY (SEQ ID NO: 2766) |
| 1077D06 | 1560 | 140 - 250 | 162 - 175 | 191 - 197 | 230 - 239 | 1 - 124 | 26 - 35 | 50 - 65 | 99 - 113 | VYYDILTGYNLFFDY (SEQ ID NO: 2177) |
| 1078B04 | 1561 | 140 - 250 | 162 - 175 | 191 - 197 | 230 - 239 | 1 - 124 | 26 - 35 | 50 - 66 | 99 - 113 | VYYDILTGYNLFFDY (SEQ ID NO: 2177) |
| 1078E10 | 1562 | 141 - 251 | 163 - 176 | 192 - 198 | 231 - 240 | 1 - 125 | 26 - 35 | 50 - 66 | 99 - 114 | MEYDILTGYYGGYFDY (SEQ ID NO: 2179) |
| 1002A01-K | 1563 | 142 - 250 | 164 - 174 | 190 - 196 | 229 - 239 | 1 - 125 | 26 - 35 | 50 - 66 | 99 - 114 | ELGLSIVGATTGALDM (SEQ ID NO: 2174) |
| 1002A01-R | 1564 | 142 - 250 | 164 - 174 | 190 - 196 | 229 - 239 | 1 - 125 | 26 - 35 | 50 - 66 | 99 - 114 | ELGLSIVGATTGALDM (SEQ ID NO: 2174) |
| 1026C04-K | 1565 | 142 - 250 | 164 - 176 | 192 - 198 | 231 - 239 | 1 - 125 | 26 - 35 | 50 - 66 | 99 - 114 | ELGLSIVGATTGALDM (SEQ ID NO: 2174) |
| 1026C04-R | 1566 | 142 - 250 | 164 - 176 | 192 - 198 | 231 - 239 | 1 - 125 | 26 - 35 | 50 - 66 | 99 - 114 | ELGLSIVGATTGALDM (SEQ ID NO: 2174) |
| 1067B10 | 1567 | 149 - 259 | 171 - 183 | 199 - 205 | 238 - 248 | 1 - 133 | 26 - 35 | 50 - 66 | 99 - 122 | DRGAPNYDILTGYYAPAQGVAFDI (SEQ ID NO: 2176) |
| 1068C06 | 1568 | 134 - 244 | 156 - 169 | 185 - 191 | 224 - 233 | 1 - 117 | 26 - 35 | 50 - 66 | 99 - 106 | DQGRYLDL (SEQ ID NO: 2175) |
| 1075F12 | 1569 | 134 - 244 | 156 - 168 | 184 - 190 | 223 - 233 | 1 - 117 | 26 - 35 | 50 - 66 | 99 - 106 | DQGRYLDL (SEQ ID NO: 2175) |
| 1003C06 | 1570 | 141 - 249 | 163 - 173 | 189 - 195 | 228 - 238 | 1 - 124 | 26 - 34 | 49 - 65 | 98 - 113 | ELGLSIVGATTGALDM (SEQ ID NO: 2174) |
| 1025B06 | 1571 | 141 - 249 | 163 - 175 | 191 - 197 | 230 - 238 | 1 - 124 | 26 - 34 | 49 - 65 | 98 - 113 | ELGLSIVGATTGALDM (SEQ ID NO: 2174) |
| 1025B09 | 1572 | 141 - 249 | 163 - 175 | 191 - 197 | 230 - 238 | 1 - 124 | 26 - 34 | 49 - 65 | 98 - 113 | ELGLSIVGATTGALDM (SEQ ID NO: 2174) |
| 1026C04 | 1573 | 141 - 249 | 163 - 175 | 191 - 197 | 230 - 238 | 1 - 124 | 26 - 34 | 49 - 65 | 98 - 113 | ELGLSIVGATTGALDM (SEQ ID NO: 2174) |
| 1027B12 | 1574 | 142 - 250 | 164 - 174 | 190 - 196 | 229 - 239 | 1 - 125 | 26 - 34 | 49 - 65 | 99 - 114 | ELGLSIVGATTGALDM (SEQ ID NO: 2174) |
| 1030A10 | 1575 | 141 - 252 | 163 - 176 | 192 - 198 | 231 - 241 | 1 - 124 | 26 - 34 | 49 - 65 | 98 - 113 | ELGLSIVGATTGALDM (SEQ ID NO: 2174) |
| 1064C04 | 1576 | 147 - 257 | 169 - 182 | 198 - 204 | 237 - 246 | 1 - 131 | 26 - 35 | 50 - 66 | 99 - 120 | DGRLSYDILTGYYARDYYGMDD (SEQ ID NO: 2188) |
| 1064C07 | 1577 | 134 - 241 | 157 - 167 | 183 - 189 | 222 - 230 | 1 - 118 | 26 - 35 | 50 - 66 | 99 - 107 | SEGTIFGVD (SEQ ID NO: 2178) |
| 1065D04 | 1578 | 144 - 254 | 166 - 179 | 195 - 201 | 234 - 243 | 1 - 128 | 26 - 36 | 51 - 66 | 99 - 117 | GKGYYDILTGYYRDNWFDP (SEQ ID NO: 2181) |
| 1065D08 | 1579 | 147 - 257 | 169 - 182 | 198 - 204 | 237 - 246 | 1 - 131 | 26 - 35 | 50 - 66 | 99 - 120 | TPSSVYDLLTGYYHYFYSYMDV (SEQ ID NO: 2189) |
| 1065F08 | 1580 | 135 - 242 | 158 - 168 | 184 - 190 | 223 - 231 | 1 - 119 | 26 - 35 | 50 - 66 | 99 - 108 | EKSAAGYFDY (SEQ ID NO: 2190) |
| 1067F05 | 1581 | 140 - 250 | 162 - 175 | 191 - 197 | 230 - 239 | 1 - 124 | 26 - 35 | 50 - 66 | 99 - 113 | ENYDSLTGYYGAFDI (SEQ ID NO: 2185) |
| 1068B04 | 1582 | 134 - 244 | 156 - 168 | 184 - 190 | 223 - 233 | 1 - 117 | 26 - 35 | 50 - 66 | 99 - 106 | DQGRYLDL (SEQ ID NO: 2175) |
| 1068B08 | 1583 | 141 - 252 | 163 - 175 | 191 - 197 | 231 - 241 | 1 - 124 | 26 - 34 | 49 - 65 | 98 - 113 | KLGLSIVGATTGALDM (SEQ ID NO: 2186) |
| 1068C08 | 1584 | 143 - 254 | 165 - 178 | 194 - 200 | 233 - 243 | 1 - 126 | 26 - 35 | 50 - 66 | 99 - 115 | EGMNDFINSHHYYYMDA (SEQ ID NO: 2182) |
| 1068F03 | 1585 | 140 - 251 | 162 - 175 | 191 - 197 | 230 - 240 | 1 - 123 | 26 - 35 | 50 - 66 | 99 - 112 | AGNEYGHTERPADY (SEQ ID NO: 2180) |
| 1069B07 | 1586 | 141 - 251 | 163 - 176 | 192 - 198 | 231 - 240 | 1 - 125 | 26 - 35 | 50 - 66 | 99 - 114 | MSYDILTGYYGGYFDY (SEQ ID NO: 2179) |
| 1071B03 | 1587 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1072B09 | 1588 | 141 - 248 | 162 - 172 | 188 - 194 | 227 - 237 | 1 - 125 | 26 - 35 | 50 - 66 | 99 - 114 | ATYDPLTGYSFDGFDI (SEQ ID NO: 2153) |
| 1073F04 | 1589 | 136 - 246 | 158 - 171 | 187 - 193 | 226 - 235 | 1 - 120 | 26 - 35 | 50 - 66 | 99 - 109 | SLATRFLGMDV (SEQ ID NO: 2184) |

| | | | | | | | | | | |
|---|---|---|---|---|---|---|---|---|---|---|
| 1074B12 | 1590 | 142 - 252 | 164 - 176 | 192 - 198 | 231 - 241 | 1 - 124 | 26 - 34 | 49 - 65 | 98 - 113 | ELGLSIVGATTGALDM (SEQ ID NO: 2174) |
| 1075A02 | 1591 | 141 - 251 | 163 - 175 | 191 - 197 | 230 - 240 | 1 - 124 | 26 - 34 | 49 - 65 | 98 - 113 | ELGLSIVGATTGALDM (SEQ ID NO: 2174) |
| 1075G01 | 1592 | 142 - 251 | 164 - 174 | 190 - 196 | 229 - 240 | 1 - 124 | 26 - 35 | 50 - 66 | 99 - 113 | DHFDTLTGYFRRLDS (SEQ ID NO: 2187) |
| 1078D02 | 1593 | 140 - 250 | 162 - 175 | 191 - 197 | 230 - 239 | 1 - 124 | 26 - 35 | 50 - 66 | 99 - 113 | VYYDILTGYNLFFDY (SEQ ID NO: 2177) |
| 1078D08 | 1594 | 144 - 251 | 165 - 175 | 191 - 197 | 230 - 240 | 1 - 128 | 26 - 35 | 50 - 66 | 99 - 117 | DAQSYYDILTGYQSYAFDI (SEQ ID NO: 2183) |
| 1078H08 | 1595 | 140 - 250 | 162 - 175 | 191 - 197 | 230 - 239 | 1 - 124 | 26 - 35 | 50 - 66 | 99 - 113 | VYYDILTGYNLFFDY (SEQ ID NO: 2177) |
| 1064A03 | 1596 | 150 - 257 | 171 - 181 | 197 - 203 | 236 - 246 | 1 - 134 | 26 - 35 | 50 - 66 | 99 - 123 | GPSTTYYDILTGYYTPYYYYYYMDV (SEQ ID NO: 3014) |
| 1064B03 | 1597 | 145 - 255 | 167 - 179 | 195 - 201 | 234 - 244 | 1 - 129 | 26 - 37 | 52 - 67 | 100 - 118 | HVRDYDILTGYYRGHYFDY (SEQ ID NO: 2167) |
| 1064B05 | 1598 | 140 - 250 | 162 - 174 | 190 - 196 | 229 - 239 | 1 - 124 | 26 - 35 | 50 - 66 | 99 - 113 | ERGVVTAYGGDSFDL (SEQ ID NO: 2985) |
| 1064B11 | 1599 | 138 - 248 | 160 - 173 | 189 - 195 | 228 - 237 | 1 - 122 | 26 - 35 | 50 - 66 | 99 - 111 | DRGPGLLSSFFES (SEQ ID NO: 3033) |
| 1064C02 | 1600 | 146 - 256 | 168 - 180 | 196 - 202 | 235 - 245 | 1 - 130 | 26 - 35 | 50 - 66 | 99 - 119 | DEYYDILTGYQAPYYYYGMDV (SEQ ID NO: 3068) |
| 1064C08 | 1601 | 140 - 250 | 162 - 175 | 191 - 197 | 230 - 239 | 1 - 124 | 26 - 35 | 50 - 66 | 99 - 113 | ERGVVTAYGGDSFDL (SEQ ID NO: 2985) |
| 1064C11 | 1602 | 143 - 253 | 165 - 178 | 194 - 200 | 233 - 242 | 1 - 127 | 26 - 35 | 50 - 65 | 98 - 116 | DVTYHDILTGYAGHEAFDI (SEQ ID NO: 3055) |
| 1064C12 | 1603 | 148 - 255 | 171 - 181 | 197 - 203 | 236 - 244 | 1 - 132 | 26 - 37 | 52 - 69 | 102 - 121 | ESGRYDILTGYYSGGGGMDV (SEQ ID NO: 3012) |
| 1064D03 | 1604 | 146 - 256 | 168 - 181 | 197 - 203 | 236 - 245 | 1 - 130 | 26 - 35 | 50 - 65 | 99 - 119 | DGANYDILTGYYTTTVYGMDV (SEQ ID NO: 3072) |
| 1064D04 | 1605 | 141 - 251 | 163 - 175 | 192 - 198 | 231 - 240 | 1 - 125 | 26 - 35 | 50 - 66 | 99 - 114 | RSYDILTGYYTYGMDV (SEQ ID NO: 3090) |
| 1064D06 | 1606 | 134 - 244 | 156 - 169 | 185 - 191 | 224 - 233 | 1 - 118 | 26 - 35 | 50 - 66 | 99 - 107 | EGSSGYLVG (SEQ ID NO: 2981) |
| 1064E05 | 1607 | 146 - 256 | 168 - 180 | 196 - 202 | 235 - 245 | 1 - 130 | 26 - 37 | 52 - 67 | 100 - 119 | KQRGDYDILTGYQLGYAFDI (SEQ ID NO: 2808) |
| 1064E06 | 1608 | 145 - 255 | 167 - 180 | 196 - 202 | 235 - 244 | 1 - 129 | 26 - 35 | 50 - 66 | 99 - 118 | ERPGYDILTGYPSSIYGMDV (SEQ ID NO: 3053) |
| 1064F07 | 1609 | 141 - 248 | 162 - 172 | 188 - 194 | 227 - 237 | 1 - 125 | 26 - 35 | 50 - 66 | 99 - 114 | ATYDPLTGYSFDGFDI (SEQ ID NO: 2153) |
| 1064F09 | 1610 | 147 - 257 | 169 - 181 | 197 - 203 | 236 - 246 | 1 - 131 | 26 - 35 | 50 - 66 | 99 - 120 | DTLGYDILTGYPPPYYYYDMDV (SEQ ID NO: 2988) |
| 1064F10 | 1611 | 143 - 253 | 165 - 177 | 193 - 199 | 232 - 242 | 1 - 127 | 22 - 31 | 46 - 62 | 95 - 116 | DTLGYDILTGYPPPYYYYDMDV (SEQ ID NO: 2988) |
| 1064F11 | 1612 | 142 - 252 | 164 - 177 | 193 - 199 | 232 - 241 | 1 - 126 | 26 - 35 | 50 - 65 | 98 - 115 | GRHYYDILTGYYNEAFDI (SEQ ID NO: 3031) |
| 1064G01 | 1613 | 140 - 250 | 162 - 175 | 191 - 197 | 230 - 239 | 1 - 124 | 26 - 35 | 50 - 66 | 99 - 113 | NYYDVLTQSYYGMDV (SEQ ID NO: 3077) |
| 1064G04 | 1614 | 133 - 243 | 155 - 167 | 183 - 189 | 222 - 232 | 1 - 117 | 26 - 35 | 50 - 66 | 99 - 106 | DNSGTYGY (SEQ ID NO: 3034) |
| 1064G08 | 1615 | 138 - 245 | 159 - 169 | 185 - 191 | 224 - 234 | 1 - 122 | 26 - 35 | 50 - 66 | 99 - 111 | GGVTAGRSVYYFDS (SEQ ID NO: 2990) |
| 1064G10 | 1616 | 140 - 250 | 162 - 175 | 191 - 197 | 230 - 239 | 1 - 124 | 26 - 35 | 50 - 66 | 99 - 113 | SPNGDYSGYAWGLEY (SEQ ID NO: 3085) |
| 1064G11 | 1617 | 138 - 248 | 160 - 173 | 189 - 195 | 228 - 237 | 1 - 122 | 26 - 35 | 50 - 65 | 98 - 111 | YFDGSGYYPVSFSY (SEQ ID NO: 3054) |
| 1064G12 | 1618 | 139 - 249 | 161 - 173 | 189 - 195 | 228 - 238 | 1 - 123 | 26 - 35 | 50 - 65 | 98 - 112 | VNYDILTGLGYYFDY (SEQ ID NO: 3049) |
| 1064H03 | 1619 | 143 - 253 | 165 - 178 | 194 - 200 | 233 - 242 | 1 - 127 | 26 - 37 | 52 - 67 | 100 - 116 | SYYDILTGRPYTDAFDI (SEQ ID NO: 2989) |
| 1064H04 | 1620 | 142 - 249 | 163 - 173 | 189 - 195 | 228 - 238 | 1 - 126 | 26 - 35 | 50 - 66 | 99 - 115 | PLGITAVRGAKTDAFGI (SEQ ID NO: 2929) |
| 1064H06 | 1621 | 149 - 256 | 170 - 180 | 196 - 202 | 235 - 245 | 1 - 133 | 26 - 35 | 50 - 66 | 99 - 122 | DRGASNYDILTGYYAPAQGVAFDI (SEQ ID NO: 2969) |
| 1065A02 | 1622 | 141 - 248 | 162 - 172 | 188 - 194 | 227 - 237 | 1 - 125 | 26 - 35 | 50 - 66 | 99 - 114 | ATYDPLTGYSFDGFDI (SEQ ID NO: 2153) |
| 1065A04 | 1623 | 141 - 248 | 162 - 172 | 188 - 194 | 227 - 237 | 1 - 125 | 26 - 35 | 50 - 66 | 99 - 114 | ATYDPLTGYSFDGFDI (SEQ ID NO: 2153) |
| 1065A06 | 1624 | 141 - 248 | 162 - 172 | 188 - 194 | 227 - 237 | 1 - 125 | 26 - 35 | 50 - 66 | 99 - 114 | ATYDPLTGYSFDGFDI (SEQ ID NO: 2153) |
| 1065A07 | 1625 | 144 - 254 | 166 - 179 | 195 - 201 | 234 - 243 | 1 - 128 | 26 - 35 | 50 - 66 | 99 - 117 | DGGGYDILTGYQYYYGMDV (SEQ ID NO: 2987) |
| 1065B01 | 1626 | 145 - 255 | 167 - 180 | 196 - 202 | 235 - 244 | 1 - 129 | 26 - 35 | 50 - 65 | 98 - 118 | WATYYDTLTGYRLKDHAGFDI (SEQ ID NO: 3017) |
| 1065B05 | 1627 | 142 - 252 | 164 - 177 | 193 - 199 | 232 - 241 | 1 - 126 | 26 - 35 | 50 - 66 | 99 - 115 | SPGDDILTGYYKYYFDY (SEQ ID NO: 3032) |
| 1065B09 | 1628 | 146 - 253 | 167 - 177 | 193 - 199 | 232 - 242 | 1 - 130 | 26 - 35 | 50 - 66 | 99 - 119 | DAGESYDILTGYYVIEGYMDV (SEQ ID NO: 2986) |
| 1065B12 | 1629 | 139 - 249 | 161 - 174 | 190 - 196 | 229 - 238 | 1 - 123 | 26 - 35 | 50 - 66 | 99 - 112 | EGAADYLNGQYFQH (SEQ ID NO: 2815) |
| 1065C02 | 1630 | 136 - 246 | 158 - 170 | 186 - 192 | 225 - 235 | 1 - 120 | 26 - 35 | 50 - 66 | 99 - 109 | EGSWSGLDLDY (SEQ ID NO: 3007) |
| 1065C06 | 1631 | 141 - 253 | 163 - 175 | 191 - 197 | 230 - 242 | 1 - 125 | 26 - 35 | 50 - 66 | 99 - 114 | ATYDPLTGYSFDGFDI (SEQ ID NO: 2153) |

| | | | | | | | | | | |
|---|---|---|---|---|---|---|---|---|---|---|
| 1065C08 | 1632 | 141 - 250 | 163 - 176 | 192 - 198 | 231 - 239 | 1 - 125 | 26 - 35 | 50 - 66 | 99 - 114 | VSGYNSGYFESYDMDV (SEQ ID NO: 2732) |
| 1065C10 | 1633 | 137 - 247 | 159 - 172 | 188 - 194 | 227 - 236 | 1 - 121 | 26 - 35 | 50 - 66 | 99 - 110 | QGGQYDSPPLDV (SEQ ID NO: 3002) |
| 1065D01 | 1634 | 142 - 252 | 164 - 177 | 193 - 199 | 232 - 241 | 1 - 126 | 26 - 35 | 50 - 66 | 99 - 115 | DRDYDILTDYSNYGMDV (SEQ ID NO: 3074) |
| 1065D03 | 1635 | 142 - 249 | 165 - 175 | 191 - 197 | 230 - 238 | 1 - 126 | 26 - 35 | 50 - 66 | 99 - 115 | AFLYDILTGYYIGGNDY (SEQ ID NO: 3028) |
| 1065D05 | 1636 | 143 - 253 | 165 - 178 | 194 - 200 | 233 - 242 | 1 - 127 | 26 - 35 | 50 - 66 | 99 - 116 | DKDYDILTGYWRDELLDY (SEQ ID NO: 3040) |
| 1065D06 | 1637 | 142 - 252 | 164 - 177 | 193 - 199 | 232 - 241 | 1 - 126 | 26 - 35 | 50 - 66 | 99 - 115 | DPNYDILTGYYYYAMDV (SEQ ID NO: 3062) |
| 1065E01 | 1638 | 139 - 246 | 160 - 170 | 186 - 192 | 225 - 235 | 1 - 123 | 26 - 35 | 50 - 66 | 99 - 112 | EHQLLARGHGMDV (SEQ ID NO: 3027) |
| 1065E05 | 1639 | 137 - 244 | 158 - 168 | 184 - 190 | 223 - 233 | 1 - 121 | 26 - 35 | 50 - 65 | 99 - 110 | AGSSLMTYGYDV (SEQ ID NO: 2773) |
| 1065E06 | 1640 | 146 - 256 | 168 - 181 | 197 - 203 | 236 - 245 | 1 - 130 | 26 - 35 | 50 - 66 | 99 - 119 | ARGSYDILTGYYRPGDGYFDY (SEQ ID NO: 3043) |
| 1065E08 | 1641 | 142 - 249 | 163 - 173 | 189 - 195 | 228 - 238 | 1 - 126 | 26 - 35 | 50 - 66 | 99 - 115 | GLYFEDTNYRHGDAFDI (SEQ ID NO: 2790) |
| 1065E09 | 1642 | 145 - 255 | 167 - 179 | 195 - 201 | 234 - 244 | 1 - 129 | 26 - 35 | 50 - 65 | 98 - 118 | ERSYYDILTGYSPRSKYGMDV (SEQ ID NO: 3021) |
| 1065E12 | 1643 | 141 - 248 | 162 - 172 | 188 - 194 | 227 - 237 | 1 - 125 | 26 - 35 | 50 - 66 | 99 - 114 | ATYDPLTGYSFDGFDI (SEQ ID NO: 2153) |
| 1065F04 | 1644 | 140 - 250 | 162 - 175 | 191 - 197 | 230 - 239 | 1 - 124 | 26 - 35 | 50 - 66 | 99 - 113 | ERGVVTAYGGDSFDL (SEQ ID NO: 2985) |
| 1065F05 | 1645 | 140 - 250 | 162 - 175 | 191 - 197 | 230 - 239 | 1 - 124 | 26 - 35 | 50 - 65 | 98 - 113 | RYSDALTGYSLGAFDV (SEQ ID NO: 3018) |
| 1065F07 | 1646 | 145 - 252 | 166 - 176 | 192 - 198 | 231 - 241 | 1 - 129 | 26 - 38 | 53 - 69 | 102 - 118 | GAYYDILTGYYPYGMDV (SEQ ID NO: 2860) |
| 1065F09 | 1647 | 143 - 250 | 164 - 174 | 190 - 196 | 229 - 239 | 1 - 127 | 26 - 35 | 50 - 66 | 99 - 116 | DYPIDVLTGRRTKNWFDP (SEQ ID NO: 3013) |
| 1065F12 | 1648 | 141 - 248 | 162 - 172 | 188 - 194 | 227 - 237 | 1 - 125 | 26 - 35 | 50 - 66 | 99 - 114 | DQYDRLLMQYNYYMDA (SEQ ID NO: 3047) |
| 1065G01 | 1649 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1065G09 | 1650 | 143 - 253 | 165 - 178 | 194 - 200 | 233 - 242 | 1 - 127 | 26 - 35 | 50 - 68 | 101 - 116 | DAYYDILTGWVYGMDV (SEQ ID NO: 3030) |
| 1065G10 | 1651 | 140 - 247 | 161 - 171 | 187 - 193 | 226 - 236 | 1 - 124 | 26 - 36 | 51 - 66 | 99 - 113 | FRYDILTGYYYDMDV (SEQ ID NO: 2983) |
| 1065H05 | 1652 | 140 - 247 | 161 - 171 | 187 - 193 | 226 - 236 | 1 - 124 | 26 - 35 | 50 - 66 | 99 - 113 | EYYDILTGYSGAFDI (SEQ ID NO: 2984) |
| 1065H07 | 1653 | 138 - 248 | 160 - 173 | 189 - 195 | 228 - 237 | 1 - 122 | 26 - 35 | 50 - 66 | 99 - 111 | TRMDVLTRYYSDF (SEQ ID NO: 2750) |
| 1066A05 | 1654 | 137 - 247 | 159 - 172 | 188 - 194 | 227 - 236 | 1 - 121 | 26 - 35 | 50 - 66 | 99 - 110 | AGSSLMTYGTDV (SEQ ID NO: 2773) |
| 1066A06 | 1655 | 139 - 246 | 160 - 170 | 186 - 192 | 225 - 235 | 1 - 123 | 26 - 35 | 50 - 65 | 99 - 112 | EGAADYLNGQYFQH (SEQ ID NO: 2815) |
| 1066A12 | 1656 | 142 - 252 | 164 - 177 | 193 - 199 | 232 - 241 | 1 - 126 | 26 - 35 | 50 - 66 | 99 - 115 | DTRVIGIQLWERGAFDM (SEQ ID NO: 3080) |
| 1066B05 | 1657 | 141 - 248 | 162 - 172 | 188 - 194 | 227 - 237 | 1 - 125 | 26 - 35 | 50 - 66 | 99 - 114 | ATYDPLTGYSFDGFDI (SEQ ID NO: 2153) |
| 1066B11 | 1658 | 142 - 252 | 164 - 177 | 193 - 199 | 232 - 241 | 1 - 126 | 26 - 35 | 50 - 66 | 99 - 115 | PLGITAVRGAKTDAFGI (SEQ ID NO: 2929) |
| 1066C05 | 1659 | 144 - 254 | 166 - 178 | 194 - 200 | 233 - 243 | 1 - 128 | 26 - 35 | 50 - 65 | 98 - 117 | GRRYYDILTGYSLGRGEMDV (SEQ ID NO: 3009) |
| 1066C10 | 1660 | 141 - 248 | 162 - 172 | 188 - 194 | 227 - 237 | 1 - 125 | 26 - 35 | 50 - 65 | 99 - 114 | ATYDPLTGYSFDGFDI (SEQ ID NO: 2153) |
| 1066D02 | 1661 | 137 - 247 | 159 - 172 | 188 - 194 | 227 - 236 | 1 - 121 | 26 - 35 | 50 - 66 | 99 - 110 | AGTSLMNYGTDV (SEQ ID NO: 3048) |
| 1066D07 | 1662 | 141 - 248 | 162 - 172 | 188 - 194 | 227 - 237 | 1 - 125 | 26 - 35 | 50 - 66 | 99 - 114 | GPYDVLTGYLSGNFDY (SEQ ID NO: 2992) |
| 1066E01 | 1663 | 137 - 247 | 159 - 172 | 188 - 194 | 227 - 236 | 1 - 121 | 26 - 35 | 50 - 66 | 99 - 110 | QGGQYDSPFFDV (SEQ ID NO: 3001) |
| 1066E03 | 1664 | 149 - 259 | 171 - 184 | 200 - 206 | 239 - 248 | 1 - 133 | 26 - 35 | 50 - 66 | 99 - 122 | GEKARYYDILTGYYSAWGGYYMDV (SEQ ID NO: 3045) |
| 1066E04 | 1665 | 141 - 248 | 162 - 172 | 188 - 194 | 227 - 237 | 1 - 125 | 26 - 35 | 50 - 66 | 99 - 114 | LNLEKTVIRGPGYFDL (SEQ ID NO: 3081) |
| 1066E05 | 1666 | 142 - 252 | 164 - 177 | 193 - 199 | 232 - 241 | 1 - 126 | 26 - 35 | 50 - 66 | 99 - 115 | VGGYDILTGYYLRGMDV (SEQ ID NO: 2997) |
| 1066E07 | 1667 | 141 - 248 | 162 - 172 | 188 - 194 | 227 - 237 | 1 - 125 | 26 - 35 | 50 - 66 | 99 - 114 | ATYDPLTGYSFDGFDI (SEQ ID NO: 2153) |
| 1066E09 | 1668 | 141 - 248 | 162 - 172 | 188 - 194 | 227 - 237 | 1 - 125 | 26 - 35 | 50 - 66 | 99 - 114 | ATYDPLTGYSFDGFDI (SEQ ID NO: 2153) |
| 1066F01 | 1669 | 141 - 251 | 163 - 176 | 192 - 198 | 231 - 240 | 1 - 125 | 26 - 35 | 50 - 66 | 99 - 114 | SPYDTLTGYVYNGVDV (SEQ ID NO: 3058) |
| 1066F03 | 1670 | 141 - 248 | 162 - 172 | 188 - 194 | 227 - 237 | 1 - 125 | 26 - 35 | 50 - 66 | 99 - 114 | ATYDPLTGYSFDGFDI (SEQ ID NO: 2153) |
| 1066F04 | 1671 | 141 - 251 | 163 - 175 | 191 - 197 | 230 - 240 | 1 - 125 | 26 - 35 | 50 - 66 | 99 - 114 | VAAAGARTLGYFGMDV (SEQ ID NO: 3071) |
| 1066F07 | 1672 | 143 - 253 | 165 - 178 | 194 - 200 | 233 - 242 | 1 - 127 | 26 - 35 | 50 - 66 | 99 - 116 | DVSGHDILTGYSYRYFDV (SEQ ID NO: 2795) |
| 1066F08 | 1673 | 144 - 254 | 166 - 179 | 195 - 201 | 234 - 243 | 1 - 128 | 26 - 35 | 50 - 66 | 99 - 117 | SPMYYDRLTGFYPSGYFDS (SEQ ID NO: 3036) |

| | | | | | | | | | | |
|---|---|---|---|---|---|---|---|---|---|---|
| 1066F11 | 1674 | 142 - 252 | 164 - 177 | 193 - 199 | 232 - 241 | 1 - 126 | 26 - 35 | 50 - 66 | 99 - 115 | GAYYDILTGYYPYGMDV (SEQ ID NO: 2860) |
| 1066F12 | 1675 | 141 - 248 | 162 - 172 | 188 - 194 | 227 - 237 | 1 - 125 | 26 - 35 | 50 - 66 | 99 - 114 | GPSSAGTTIGLGSFDP (SEQ ID NO: 3005) |
| 1066G06 | 1676 | 143 - 250 | 164 - 174 | 190 - 196 | 229 - 239 | 1 - 127 | 26 - 35 | 50 - 66 | 99 - 116 | ETRKYTSSPPYNYYYMDV (SEQ ID NO: 2736) |
| 1066G07 | 1677 | 133 - 243 | 155 - 168 | 184 - 190 | 223 - 232 | 1 - 117 | 26 - 30 | 45 - 61 | 94 - 106 | DQFSVGGRHAFDL (SEQ ID NO: 3054) |
| 1066H02 | 1678 | 135 - 242 | 156 - 166 | 182 - 188 | 221 - 231 | 1 - 119 | 26 - 35 | 50 - 66 | 99 - 108 | GMGDHYGMDV (SEQ ID NO: 2161) |
| 1067A02 | 1679 | 141 - 248 | 162 - 172 | 188 - 194 | 227 - 237 | 1 - 125 | 26 - 35 | 50 - 66 | 99 - 114 | ATYDPLTGYSFDGFDI (SEQ ID NO: 2153) |
| 1067A03 | 1680 | 137 - 247 | 159 - 172 | 188 - 194 | 227 - 236 | 1 - 121 | 26 - 35 | 50 - 66 | 99 - 110 | AGSSLMTYGTDV (SEQ ID NO: 2773) |
| 1067A06 | 1681 | 141 - 248 | 162 - 172 | 188 - 194 | 227 - 237 | 1 - 125 | 26 - 35 | 50 - 66 | 99 - 114 | ATYDPLTGYSFDGFDI (SEQ ID NO: 2153) |
| 1067A08 | 1682 | 137 - 247 | 159 - 171 | 187 - 193 | 226 - 236 | 1 - 121 | 26 - 35 | 50 - 66 | 99 - 110 | AGSSLMTYGTDV (SEQ ID NO: 2773) |
| 1067A10 | 1683 | 140 - 250 | 162 - 175 | 191 - 197 | 230 - 239 | 1 - 124 | 26 - 35 | 50 - 66 | 99 - 113 | ERGVVTAYGGDSFDL (SEQ ID NO: 2985) |
| 1067B03 | 1684 | 142 - 253 | 164 - 177 | 193 - 199 | 232 - 242 | 1 - 126 | 26 - 35 | 50 - 66 | 99 - 115 | PLGITAVRGAKTDAFGI (SEQ ID NO: 2929) |
| 1067B04 | 1685 | 137 - 247 | 159 - 172 | 188 - 194 | 227 - 236 | 1 - 121 | 26 - 35 | 50 - 66 | 99 - 110 | AGSSLMTYGTDV (SEQ ID NO: 2773) |
| 1067C03 | 1686 | 134 - 244 | 156 - 169 | 185 - 191 | 224 - 233 | 1 - 117 | 26 - 35 | 50 - 66 | 99 - 106 | DWGHWFDP (SEQ ID NO: 2982) |
| 1067C05 | 1687 | 137 - 247 | 159 - 172 | 188 - 194 | 227 - 236 | 1 - 121 | 26 - 35 | 50 - 66 | 99 - 110 | SGSSLMTYGTDV (SEQ ID NO: 3015) |
| 1067C07 | 1688 | 141 - 251 | 163 - 176 | 192 - 198 | 231 - 240 | 1 - 125 | 26 - 35 | 50 - 66 | 99 - 114 | EPYDILTGYYGSYFDY (SEQ ID NO: 3041) |
| 1067C10 | 1689 | 137 - 247 | 159 - 172 | 188 - 194 | 227 - 236 | 1 - 121 | 26 - 35 | 50 - 66 | 99 - 110 | AGSSLMTYGTDV (SEQ ID NO: 2773) |
| 1067C12 | 1690 | 142 - 252 | 164 - 177 | 193 - 199 | 232 - 241 | 1 - 126 | 26 - 35 | 50 - 66 | 99 - 115 | TYYDILTGYSGGGAFDY (SEQ ID NO: 3024) |
| 1067D01 | 1691 | 136 - 246 | 158 - 171 | 187 - 193 | 226 - 235 | 1 - 120 | 26 - 35 | 50 - 66 | 99 - 109 | GSRVRGVIPDL (SEQ ID NO: 3020) |
| 1067D03 | 1692 | 137 - 244 | 158 - 168 | 184 - 190 | 223 - 233 | 1 - 121 | 26 - 35 | 50 - 66 | 99 - 110 | AGSSLMTYGTDV (SEQ ID NO: 2773) |
| 1067D05 | 1693 | 146 - 256 | 168 - 180 | 196 - 202 | 235 - 245 | 1 - 130 | 26 - 35 | 50 - 66 | 99 - 119 | ECSGSSCPARQPPYYQYYMDV (SEQ ID NO: 2993) |
| 1067D06 | 1694 | 137 - 244 | 158 - 168 | 184 - 190 | 223 - 233 | 1 - 121 | 26 - 35 | 50 - 66 | 99 - 110 | AGSSLMTYGTDV (SEQ ID NO: 2773) |
| 1067D09 | 1695 | 142 - 252 | 164 - 177 | 193 - 199 | 232 - 241 | 1 - 126 | 26 - 35 | 50 - 66 | 99 - 115 | GAYYDILTGYYPYGMDV (SEQ ID NO: 2860) |
| 1067D12 | 1696 | 137 - 247 | 159 - 172 | 188 - 194 | 227 - 236 | 1 - 121 | 26 - 35 | 50 - 66 | 99 - 110 | QGGQYDSPPLDV (SEQ ID NO: 3002) |
| 1067E02 | 1697 | 137 - 247 | 159 - 172 | 188 - 194 | 227 - 236 | 1 - 121 | 26 - 35 | 50 - 66 | 99 - 110 | AGSSLMTYGTDV (SEQ ID NO: 2773) |
| 1067E04 | 1698 | 142 - 252 | 164 - 176 | 192 - 198 | 231 - 241 | 1 - 126 | 26 - 35 | 50 - 66 | 99 - 115 | GAYYDILTGYYPYGMDV (SEQ ID NO: 2860) |
| 1067E05 | 1699 | 144 - 254 | 166 - 179 | 195 - 201 | 234 - 243 | 1 - 128 | 26 - 35 | 50 - 66 | 99 - 117 | DYRNYDILTGHPYYYGMDV (SEQ ID NO: 2996) |
| 1067F01 | 1700 | 141 - 248 | 164 - 174 | 190 - 196 | 229 - 237 | 1 - 125 | 26 - 35 | 50 - 66 | 99 - 114 | QHYDILTGYSQEPFDI (SEQ ID NO: 3022) |
| 1067F03 | 1701 | 144 - 254 | 166 - 179 | 195 - 201 | 234 - 243 | 1 - 128 | 26 - 35 | 50 - 66 | 99 - 117 | DQTYYDILTGHYYYYGMDV (SEQ ID NO: 3087) |
| 1067F04 | 1702 | 139 - 246 | 160 - 170 | 186 - 192 | 225 - 235 | 1 - 123 | 26 - 35 | 50 - 66 | 99 - 112 | EGAADYLNGQYFQH (SEQ ID NO: 2815) |
| 1067F08 | 1703 | 140 - 247 | 161 - 171 | 187 - 193 | 226 - 236 | 1 - 124 | 26 - 35 | 50 - 66 | 99 - 113 | LGYYDILTGYRSDDY (SEQ ID NO: 3029) |
| 1067F10 | 1704 | 137 - 247 | 159 - 172 | 188 - 194 | 227 - 236 | 1 - 121 | 26 - 35 | 50 - 66 | 99 - 110 | AGSSLMAYGTDV (SEQ ID NO: 3016) |
| 1067F11 | 1705 | 140 - 248 | 161 - 171 | 187 - 193 | 226 - 237 | 1 - 124 | 26 - 35 | 50 - 66 | 99 - 113 | ENYDFLTGYYGAFDI (SEQ ID NO: 2772) |
| 1067G01 | 1706 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1067G09 | 1707 | 137 - 247 | 159 - 171 | 187 - 193 | 226 - 236 | 1 - 121 | 26 - 35 | 50 - 66 | 99 - 110 | AGSSLMTYGTDV (SEQ ID NO: 2773) |
| 1067H07 | 1708 | 144 - 251 | 165 - 175 | 191 - 197 | 230 - 240 | 1 - 128 | 26 - 35 | 50 - 66 | 99 - 117 | GGLYDILTGRPATDDAFDI (SEQ ID NO: 3035) |
| 1068A07 | 1709 | 143 - 254 | 165 - 178 | 194 - 200 | 233 - 243 | 1 - 126 | 26 - 35 | 50 - 66 | 99 - 115 | TDRFGAKDVTARWGMDV (SEQ ID NO: 2979) |
| 1068E05 | 1710 | 148 - 257 | 170 - 183 | 199 - 205 | 238 - 246 | 1 - 131 | 26 - 35 | 50 - 66 | 99 - 120 | GREDTDKVKPWDRYYHYYYMDV (SEQ ID NO: 2809) |
| 1068E08 | 1711 | 135 - 247 | 157 - 169 | 185 - 193 | 226 - 236 | 1 - 117 | 26 - 35 | 50 - 66 | 99 - 106 | DQGRYLDL (SEQ ID NO: 2175) |
| 1068E11 | 1712 | 141 - 251 | 163 - 176 | 192 - 198 | 231 - 240 | 1 - 124 | 26 - 34 | 49 - 65 | 98 - 113 | ELGLSIVGATTGALDM (SEQ ID NO: 2174) |
| 1068F04 | 1713 | 142 - 252 | 164 - 176 | 192 - 198 | 231 - 241 | 1 - 125 | 26 - 35 | 50 - 66 | 99 - 114 | ELGHREGGYWYSPYNV (SEQ ID NO: 2838) |
| 1068G05 | 1714 | 137 - 245 | 159 - 169 | 185 - 191 | 224 - 234 | 1 - 119 | 26 - 35 | 50 - 66 | 98 - 108 | KNMGASAAADF (SEQ ID NO: 3042) |
| 1068G06 | 1715 | 140 - 250 | 162 - 174 | 190 - 196 | 229 - 239 | 1 - 123 | 26 - 35 | 50 - 66 | 99 - 112 | RYGDFFYYYYYMNV (SEQ ID NO: 2755) |

| | | | | | | | | | | |
|---|---|---|---|---|---|---|---|---|---|---|
| 1068G11 | 1716 | 147 - 258 | 169 - 182 | 198 - 204 | 237 - 247 | 1 - 130 | 26 - 35 | 50 - 66 | 99 - 119 | ESGSHYDLLTGLLVAANGFDV (SEQ ID NO: 3044) |
| 1069A09 | 1717 | 141 - 248 | 164 - 174 | 190 - 196 | 229 - 237 | 1 - 125 | 26 - 35 | 50 - 66 | 99 - 114 | MEYDILTGYYGGYFDY (SEQ ID NO: 2179) |
| 1069A10 | 1718 | 141 - 248 | 162 - 172 | 188 - 194 | 227 - 237 | 1 - 125 | 26 - 35 | 50 - 66 | 99 - 114 | MEYDILTGYYGGYFDY (SEQ ID NO: 2179) |
| 1069B06 | 1719 | 141 - 248 | 164 - 174 | 190 - 196 | 229 - 237 | 1 - 125 | 26 - 35 | 50 - 66 | 99 - 114 | MEYDILTGYYGGYFDY (SEQ ID NO: 2179) |
| 1069B09 | 1720 | 139 - 249 | 161 - 174 | 190 - 196 | 229 - 238 | 1 - 123 | 26 - 35 | 50 - 66 | 99 - 112 | PYYDILTGYFAFDI (SEQ ID NO: 3026) |
| 1069B12 | 1721 | 141 - 248 | 162 - 172 | 188 - 194 | 227 - 237 | 1 - 125 | 26 - 35 | 50 - 66 | 99 - 114 | MEYDILTGYYGGYFDY (SEQ ID NO: 2179) |
| 1069C06 | 1722 | 143 - 250 | 164 - 174 | 190 - 196 | 229 - 239 | 1 - 127 | 26 - 35 | 50 - 66 | 99 - 116 | VLPHYDILTGYSQNWFDP (SEQ ID NO: 3000) |
| 1069C09 | 1723 | 143 - 250 | 164 - 174 | 190 - 196 | 229 - 239 | 1 - 127 | 26 - 35 | 50 - 66 | 99 - 116 | VLPHYDILTGYSQNWFDP (SEQ ID NO: 3000) |
| 1069D03 | 1724 | 142 - 249 | 163 - 173 | 189 - 195 | 228 - 238 | 1 - 126 | 26 - 35 | 50 - 66 | 99 - 115 | DGYYDILTGYSYYGMDV (SEQ ID NO: 2135) |
| 1069E09 | 1725 | 142 - 249 | 163 - 173 | 189 - 195 | 228 - 238 | 1 - 126 | 26 - 35 | 50 - 66 | 99 - 115 | DGYYDILTGYSYYGMDV (SEQ ID NO: 2135) |
| 1069E11 | 1726 | 140 - 247 | 161 - 171 | 187 - 193 | 226 - 236 | 1 - 124 | 26 - 35 | 50 - 66 | 99 - 113 | VYYDILTGYNLFFDY (SEQ ID NO: 2177) |
| 1069F05 | 1727 | 141 - 248 | 162 - 172 | 188 - 194 | 227 - 237 | 1 - 125 | 26 - 35 | 50 - 66 | 99 - 114 | MEYDILTGYYGGYFDY (SEQ ID NO: 2179) |
| 1069F07 | 1728 | 141 - 248 | 162 - 172 | 188 - 194 | 227 - 237 | 1 - 125 | 26 - 35 | 50 - 66 | 99 - 114 | MEYDILTGYYGGYFDY (SEQ ID NO: 2179) |
| 1069F12 | 1729 | 140 - 247 | 161 - 171 | 187 - 193 | 226 - 236 | 1 - 124 | 26 - 35 | 50 - 66 | 99 - 113 | GYYDILTGYYDAFDI (SEQ ID NO: 3051) |
| 1069G06 | 1730 | 142 - 249 | 163 - 173 | 189 - 195 | 228 - 238 | 1 - 126 | 26 - 35 | 50 - 66 | 99 - 115 | DGYYDILTGYSGYYMDV (SEQ ID NO: 3059) |
| 1069G08 | 1731 | 145 - 252 | 166 - 176 | 192 - 198 | 231 - 241 | 1 - 129 | 26 - 35 | 50 - 66 | 99 - 118 | DRLEYYDILTGYYYYYGMDV (SEQ ID NO: 3039) |
| 1069G11 | 1732 | 141 - 248 | 162 - 172 | 188 - 194 | 227 - 237 | 1 - 125 | 26 - 35 | 50 - 66 | 99 - 114 | MEYDILTGYYGGYFDY (SEQ ID NO: 2179) |
| 1070A03 | 1733 | 141 - 248 | 164 - 174 | 190 - 196 | 229 - 237 | 1 - 125 | 26 - 35 | 50 - 66 | 99 - 114 | MEYDILTGYYGGYFDY (SEQ ID NO: 2179) |
| 1070A09 | 1734 | 141 - 248 | 162 - 172 | 188 - 194 | 227 - 237 | 1 - 125 | 26 - 35 | 50 - 66 | 99 - 114 | MEYDILTGYYGGYFDY (SEQ ID NO: 2179) |
| 1070B01 | 1735 | 144 - 254 | 166 - 179 | 195 - 201 | 234 - 243 | 1 - 128 | 26 - 35 | 50 - 66 | 99 - 117 | SQSDYDILTGYYYYYGMDV (SEQ ID NO: 3038) |
| 1070B05 | 1736 | 141 - 251 | 163 - 176 | 192 - 198 | 231 - 240 | 1 - 125 | 26 - 35 | 50 - 66 | 99 - 114 | MEYDILTGYYGGYFDY (SEQ ID NO: 2179) |
| 1070D03 | 1737 | 141 - 248 | 164 - 174 | 190 - 196 | 229 - 237 | 1 - 125 | 26 - 35 | 50 - 66 | 99 - 114 | MEYDILTGYYGGYFDY (SEQ ID NO: 2179) |
| 1070D04 | 1738 | 141 - 251 | 163 - 176 | 192 - 198 | 231 - 240 | 1 - 125 | 26 - 35 | 50 - 66 | 99 - 114 | MEYDILTSYYGGYFDY (SEQ ID NO: 3034) |
| 1070E01 | 1739 | 144 - 254 | 166 - 179 | 195 - 201 | 234 - 243 | 1 - 128 | 26 - 35 | 50 - 66 | 99 - 117 | SQSDYDILTGYYYYYGMDV (SEQ ID NO: 3038) |
| 1070F01 | 1740 | 144 - 251 | 165 - 175 | 191 - 197 | 230 - 240 | 1 - 128 | 26 - 35 | 50 - 66 | 99 - 117 | SQSNYDILTGYYYYYGMDV (SEQ ID NO: 3057) |
| 1070G10 | 1741 | 141 - 248 | 162 - 172 | 188 - 194 | 227 - 237 | 1 - 125 | 26 - 35 | 50 - 66 | 99 - 114 | MEYDILTGYYGGYFDY (SEQ ID NO: 2179) |
| 1071A06 | 1742 | 135 - 242 | 156 - 166 | 182 - 188 | 221 - 231 | 1 - 119 | 26 - 35 | 50 - 66 | 99 - 108 | GMGDHYGMDV (SEQ ID NO: 2161) |
| 1071B02 | 1743 | 135 - 245 | 157 - 170 | 185 - 192 | 225 - 234 | 1 - 119 | 26 - 35 | 50 - 66 | 99 - 108 | GMGDHYGMDV (SEQ ID NO: 2161) |
| 1071D02 | 1744 | 137 - 247 | 159 - 172 | 188 - 194 | 227 - 236 | 1 - 121 | 26 - 35 | 50 - 66 | 99 - 110 | AGTSLMNYGTDV (SEQ ID NO: 3048) |
| 1071D08 | 1745 | 146 - 256 | 168 - 181 | 197 - 203 | 236 - 245 | 1 - 130 | 26 - 37 | 52 - 66 | 99 - 119 | VPYYYDISGGYLGEYYYGMDV (SEQ ID NO: 3010) |
| 1071F01 | 1746 | 137 - 247 | 159 - 172 | 188 - 194 | 227 - 236 | 1 - 121 | 26 - 35 | 50 - 66 | 99 - 110 | AGTSLMNYGTDV (SEQ ID NO: 3048) |
| 1071G09 | 1747 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1072A01 | 1748 | 139 - 249 | 161 - 174 | 190 - 196 | 229 - 238 | 1 - 123 | 26 - 35 | 50 - 66 | 99 - 112 | SRDLLLFPHYGMDV (SEQ ID NO: 2133) |
| 1072A09 | 1749 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1072B02 | 1750 | 135 - 245 | 157 - 170 | 186 - 192 | 225 - 234 | 1 - 119 | 26 - 35 | 50 - 66 | 99 - 108 | GMGDHYGMDV (SEQ ID NO: 2161) |
| 1072B10 | 1751 | 137 - 247 | 159 - 172 | 188 - 194 | 227 - 236 | 1 - 121 | 26 - 35 | 50 - 66 | 99 - 110 | AGSSLMTYGTDV (SEQ ID NO: 2773) |
| 1072B11 | 1752 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1072B12 | 1753 | 140 - 249 | 162 - 173 | 189 - 195 | 228 - 238 | 1 - 124 | 26 - 35 | 50 - 66 | 99 - 113 | ENYDYLTGYYGAFDI (SEQ ID NO: 2995) |
| 1072C05 | 1754 | 135 - 245 | 157 - 169 | 185 - 191 | 224 - 234 | 1 - 119 | 26 - 35 | 50 - 66 | 99 - 108 | GMGDHYGMDV (SEQ ID NO: 2161) |
| 1072C10 | 1755 | 141 - 248 | 162 - 172 | 188 - 194 | 227 - 237 | 1 - 125 | 26 - 35 | 50 - 66 | 99 - 114 | ATYDPLTGYSFDGFDI (SEQ ID NO: 2153) |
| 1072D01 | 1756 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1072D05 | 1757 | 135 - 245 | 157 - 169 | 185 - 191 | 224 - 234 | 1 - 119 | 26 - 35 | 50 - 66 | 99 - 108 | GMGDHYGMDV (SEQ ID NO: 2161) |

| | | | | | | | | | | |
|---|---|---|---|---|---|---|---|---|---|---|
| I072E01 | 1758 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| I072E04 | 1759 | 144 - 254 | 166 - 179 | 195 - 201 | 234 - 243 | 1 - 128 | 26 - 35 | 50 - 66 | 99 - 117 | EGSYDILTGYYVGVGRMDV (SEQ ID NO: 2171) |
| I072E05 | 1760 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| I072E06 | 1761 | 135 - 242 | 156 - 166 | 182 - 188 | 221 - 231 | 1 - 119 | 26 - 35 | 50 - 66 | 99 - 108 | GMGDHYGMDV (SEQ ID NO: 2161) |
| I072F03 | 1762 | 135 - 242 | 156 - 166 | 182 - 188 | 221 - 231 | 1 - 119 | 26 - 35 | 50 - 66 | 99 - 108 | GMGDHYGMDV (SEQ ID NO: 2161) |
| I072F07 | 1763 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| I072F11 | 1764 | 140 - 247 | 161 - 171 | 187 - 193 | 226 - 236 | 1 - 124 | 26 - 35 | 50 - 66 | 99 - 113 | DEYDILTGLLQGMDV (SEQ ID NO: 2883) |
| I072G03 | 1765 | 141 - 248 | 162 - 172 | 188 - 194 | 227 - 237 | 1 - 125 | 26 - 35 | 50 - 66 | 99 - 114 | ATYDPLTGYSFDGFDI (SEQ ID NO: 2153) |
| I072G04 | 1766 | 137 - 247 | 159 - 171 | 187 - 193 | 226 - 236 | 1 - 121 | 26 - 35 | 50 - 68 | 101 - 110 | RDILTGFYDS (SEQ ID NO: 2933) |
| I072G05 | 1767 | 137 - 247 | 159 - 171 | 187 - 193 | 226 - 236 | 1 - 121 | 26 - 35 | 50 - 66 | 99 - 110 | GYRNDWYGAFEI (SEQ ID NO: 3079) |
| I072G09 | 1768 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| I072H03 | 1769 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| I072H07 | 1770 | 137 - 247 | 159 - 172 | 188 - 194 | 227 - 236 | 1 - 121 | 26 - 35 | 50 - 66 | 99 - 110 | AGTSLMNYGMDV (SEQ ID NO: 3070) |
| I073A02 | 1771 | 141 - 248 | 164 - 174 | 190 - 196 | 229 - 237 | 1 - 125 | 26 - 35 | 50 - 66 | 99 - 114 | GPYDILTGYYRDAFDI (SEQ ID NO: 2998) |
| I073A03 | 1772 | 142 - 252 | 164 - 177 | 193 - 199 | 232 - 241 | 1 - 126 | 26 - 35 | 50 - 66 | 99 - 115 | THYDILTGYYTADAFDI (SEQ ID NO: 3019) |
| I073A04 | 1773 | 148 - 258 | 170 - 183 | 199 - 205 | 238 - 247 | 1 - 132 | 26 - 35 | 50 - 66 | 99 - 121 | VQMDSEYYDLLTGINVGPYYFDY (SEQ ID NO: 2137) |
| I073A05 | 1774 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| I073A06 | 1775 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| I073A09 | 1776 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| I073A10 | 1777 | 146 - 253 | 167 - 177 | 193 - 199 | 232 - 242 | 1 - 130 | 26 - 35 | 50 - 66 | 99 - 119 | GDFGDYDILTGYYPVYYGMDV (SEQ ID NO: 3082) |
| I073A11 | 1778 | 141 - 248 | 164 - 174 | 190 - 196 | 229 - 237 | 1 - 125 | 26 - 35 | 50 - 66 | 99 - 114 | SYYDILTGYYFFGMDV (SEQ ID NO: 3004) |
| I073B02 | 1779 | 144 - 254 | 166 - 179 | 195 - 201 | 234 - 243 | 1 - 128 | 26 - 35 | 50 - 66 | 99 - 117 | DLWYYDILTGYYLDDAFDI (SEQ ID NO: 2999) |
| I073B05 | 1780 | 144 - 254 | 166 - 179 | 195 - 201 | 234 - 243 | 1 - 128 | 26 - 35 | 50 - 66 | 99 - 117 | DLWYYDILTGYYLDDAFDI (SEQ ID NO: 2999) |
| I073B06 | 1781 | 139 - 246 | 160 - 170 | 186 - 192 | 225 - 235 | 1 - 123 | 26 - 35 | 50 - 66 | 99 - 112 | SRDLLLFPHYGMDV (SEQ ID NO: 2133) |
| I073B07 | 1782 | 138 - 248 | 160 - 173 | 189 - 195 | 228 - 237 | 1 - 122 | 26 - 35 | 50 - 66 | 99 - 111 | TRMDVLTRYYSDF (SEQ ID NO: 2750) |
| I073B08 | 1783 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| I073B11 | 1784 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| I073C01 | 1785 | 141 - 248 | 162 - 172 | 188 - 194 | 227 - 237 | 1 - 125 | 26 - 35 | 50 - 66 | 99 - 114 | GYHDTLTSYNYNWFDP (SEQ ID NO: 3006) |
| I073C02 | 1786 | 148 - 255 | 169 - 179 | 195 - 201 | 234 - 244 | 1 - 132 | 26 - 35 | 50 - 66 | 99 - 121 | AQMDSEYYDLLTGINVGPYYFDY (SEQ ID NO: 3076) |
| I073C04 | 1787 | 143 - 252 | 164 - 177 | 193 - 199 | 232 - 241 | 1 - 125 | 26 - 35 | 50 - 66 | 99 - 114 | ATYDPLTGYSFDGFDI (SEQ ID NO: 2153) |
| I073C07 | 1788 | 134 - 241 | 155 - 165 | 181 - 187 | 220 - 230 | 1 - 118 | 26 - 35 | 50 - 66 | 99 - 107 | GMGDHYMDV (SEQ ID NO: 3008) |
| I073C08 | 1789 | 142 - 252 | 164 - 177 | 193 - 199 | 232 - 241 | 1 - 126 | 26 - 35 | 50 - 66 | 99 - 115 | EMGYDILTGYYLNYMDV (SEQ ID NO: 2862) |
| I073C09 | 1790 | 141 - 248 | 162 - 172 | 188 - 194 | 227 - 237 | 1 - 125 | 26 - 35 | 50 - 66 | 99 - 114 | QHYDILTGYSQEPFDI (SEQ ID NO: 3022) |
| I073C11 | 1791 | 146 - 256 | 168 - 181 | 197 - 203 | 236 - 245 | 1 - 130 | 26 - 35 | 50 - 68 | 101 - 119 | FNPTYDILTGYYIGGYFQH (SEQ ID NO: 2155) |
| I073C12 | 1792 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| I073D01 | 1793 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| I073D03 | 1794 | 135 - 245 | 157 - 169 | 185 - 191 | 224 - 234 | 1 - 119 | 26 - 35 | 50 - 66 | 99 - 108 | GMGDHYGMDV (SEQ ID NO: 2161) |
| I073D06 | 1795 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| I073D08 | 1796 | 144 - 254 | 166 - 179 | 195 - 201 | 234 - 243 | 1 - 128 | 26 - 35 | 50 - 66 | 99 - 117 | EVRNYDLLTRSYLAGPLDN (SEQ ID NO: 2751) |
| I073D10 | 1797 | 140 - 250 | 162 - 175 | 191 - 197 | 230 - 239 | 1 - 124 | 26 - 35 | 50 - 68 | 101 - 113 | QYYDILTGYELDI (SEQ ID NO: 3073) |
| I073D11 | 1798 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| I073E01 | 1799 | 148 - 258 | 170 - 183 | 199 - 205 | 238 - 247 | 1 - 132 | 26 - 37 | 52 - 69 | 102 - 121 | EGAHYDILTGHNYYHYGMDV (SEQ ID NO: 2747) |

| | | | | | | | | | | |
|---|---|---|---|---|---|---|---|---|---|---|
| 1073E02 | 1800 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1073E03 | 1801 | 141 - 251 | 163 - 176 | 192 - 198 | 231 - 240 | 1 - 125 | 26 - 35 | 50 - 66 | 99 - 114 | ATYDPLTGYSLDGFDI (SEQ ID NO: 3003) |
| 1073E05 | 1802 | 141 - 251 | 163 - 176 | 192 - 198 | 231 - 240 | 1 - 125 | 26 - 35 | 50 - 66 | 99 - 114 | QHYDILTGYSQEPFDI (SEQ ID NO: 3022) |
| 1073E06 | 1803 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1073E08 | 1804 | 140 - 250 | 162 - 175 | 191 - 197 | 230 - 239 | 1 - 124 | 26 - 35 | 50 - 66 | 99 - 113 | ENYDPLTGYYQAFDI (SEQ ID NO: 2772) |
| 1073F01 | 1805 | 141 - 251 | 163 - 175 | 191 - 197 | 230 - 240 | 1 - 125 | 26 - 35 | 50 - 66 | 99 - 114 | ATYDPLTGYSFDGFDI (SEQ ID NO: 2153) |
| 1073F02 | 1806 | 141 - 251 | 163 - 175 | 191 - 197 | 230 - 240 | 1 - 125 | 26 - 35 | 50 - 66 | 99 - 114 | ATYDPLTGYSFDGFDI (SEQ ID NO: 2153) |
| 1073F03 | 1807 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1073F05 | 1808 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1073F07 | 1809 | 141 - 251 | 163 - 175 | 191 - 197 | 230 - 240 | 1 - 125 | 26 - 35 | 50 - 66 | 99 - 114 | GEYDILTGYPYWYFDL (SEQ ID NO: 3023) |
| 1073F09 | 1810 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1073F11 | 1811 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1073F12 | 1812 | 141 - 251 | 163 - 175 | 191 - 197 | 230 - 240 | 1 - 125 | 26 - 35 | 50 - 66 | 99 - 114 | ATYDPLTGYSFDGFDI (SEQ ID NO: 2153) |
| 1073G03 | 1813 | 143 - 253 | 165 - 178 | 194 - 200 | 233 - 242 | 1 - 127 | 26 - 35 | 50 - 66 | 99 - 116 | DGSYDILTGYYIDNYMDV (SEQ ID NO: 2154) |
| 1073G04 | 1814 | 143 - 253 | 165 - 178 | 194 - 200 | 233 - 242 | 1 - 127 | 26 - 35 | 50 - 65 | 98 - 116 | GEGGYDILTGYLRGYGMDV (SEQ ID NO: 3037) |
| 1073G05 | 1815 | 135 - 245 | 157 - 169 | 185 - 191 | 224 - 234 | 1 - 119 | 26 - 35 | 50 - 66 | 99 - 108 | GMGDHYGMDV (SEQ ID NO: 2161) |
| 1073G06 | 1816 | 141 - 248 | 162 - 172 | 188 - 194 | 227 - 237 | 1 - 125 | 26 - 35 | 50 - 66 | 99 - 114 | ATYDPLTGYSFDGFDI (SEQ ID NO: 2153) |
| 1073G07 | 1817 | 142 - 249 | 163 - 173 | 189 - 195 | 228 - 238 | 1 - 126 | 26 - 35 | 50 - 66 | 99 - 115 | GSYYDILTGISSLGMDV (SEQ ID NO: 3063) |
| 1073G08 | 1818 | 139 - 246 | 160 - 170 | 186 - 192 | 225 - 235 | 1 - 123 | 26 - 35 | 50 - 66 | 99 - 112 | SRDLLLFPHYGMDV (SEQ ID NO: 2133) |
| 1073G09 | 1819 | 145 - 255 | 167 - 180 | 196 - 202 | 235 - 244 | 1 - 129 | 26 - 35 | 50 - 66 | 99 - 118 | DRGHYDILTGYYIEPSGFDY (SEQ ID NO: 3061) |
| 1073G10 | 1820 | 135 - 245 | 157 - 170 | 186 - 192 | 225 - 234 | 1 - 119 | 26 - 35 | 50 - 66 | 99 - 108 | GPGVIGNYDY (SEQ ID NO: 2749) |
| 1073G12 | 1821 | 142 - 252 | 164 - 177 | 193 - 199 | 232 - 241 | 1 - 126 | 26 - 35 | 50 - 68 | 101 - 115 | GGMIRAREDYYYMDV (SEQ ID NO: 3083) |
| 1073H01 | 1822 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1073H03 | 1823 | 141 - 248 | 162 - 172 | 188 - 194 | 227 - 237 | 1 - 125 | 26 - 35 | 50 - 66 | 99 - 114 | ATYDPLTGYSFDGFDI (SEQ ID NO: 2153) |
| 1073H05 | 1824 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1073H06 | 1825 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1073H07 | 1826 | 138 - 245 | 159 - 169 | 185 - 191 | 224 - 234 | 1 - 122 | 26 - 35 | 50 - 66 | 99 - 111 | TYYDILTGYYFDY (SEQ ID NO: 3056) |
| 1073H08 | 1827 | 141 - 251 | 163 - 176 | 192 - 198 | 231 - 240 | 1 - 125 | 26 - 35 | 50 - 66 | 99 - 114 | ATYDPLTGYSFDGFDI (SEQ ID NO: 2153) |
| 1074A05 | 1828 | 144 - 255 | 166 - 179 | 195 - 201 | 234 - 244 | 1 - 127 | 26 - 35 | 50 - 66 | 99 - 116 | LPPYDMLTGYYVGGGMDV (SEQ ID NO: 3050) |
| 1074A06 | 1829 | 145 - 253 | 167 - 177 | 193 - 199 | 232 - 242 | 1 - 127 | 26 - 35 | 50 - 66 | 99 - 116 | AKPYTDFSRGSDADAFDV (SEQ ID NO: 3065) |
| 1074B03 | 1830 | 134 - 242 | 156 - 166 | 182 - 188 | 221 - 231 | 1 - 117 | 26 - 35 | 50 - 66 | 99 - 106 | DQGRYLDL (SEQ ID NO: 2175) |
| 1074B11 | 1831 | 140 - 251 | 162 - 175 | 191 - 197 | 230 - 240 | 1 - 123 | 26 - 35 | 50 - 66 | 99 - 112 | RYGDFFYYYYYMNV (SEQ ID NO: 2755) |
| 1074C07 | 1832 | 141 - 251 | 163 - 175 | 191 - 197 | 230 - 240 | 1 - 124 | 26 - 34 | 49 - 65 | 98 - 113 | ELGLSIVGATTGALDM (SEQ ID NO: 2174) |
| 1074D03 | 1833 | 143 - 251 | 165 - 175 | 191 - 197 | 230 - 240 | 1 - 125 | 26 - 35 | 50 - 66 | 99 - 114 | GGYDILTQYFAEFFHP (SEQ ID NO: 2764) |
| 1074D04 | 1834 | 134 - 246 | 156 - 169 | 185 - 191 | 224 - 235 | 1 - 117 | 26 - 35 | 50 - 66 | 99 - 106 | DQGRYLDL (SEQ ID NO: 2175) |
| 1074D05 | 1835 | 145 - 253 | 167 - 177 | 193 - 199 | 232 - 242 | 1 - 127 | 26 - 35 | 50 - 66 | 99 - 116 | DRYYDILTKGDYYYGMDV (SEQ ID NO: 3060) |
| 1074D07 | 1836 | 151 - 262 | 173 - 186 | 202 - 208 | 241 - 251 | 1 - 134 | 26 - 35 | 50 - 66 | 99 - 123 | VQGSTYYDILTGYWGPKRDLYGMDV (SEQ ID NO: 3069) |
| 1074D08 | 1837 | 141 - 251 | 163 - 175 | 191 - 197 | 230 - 240 | 1 - 124 | 26 - 34 | 49 - 65 | 98 - 113 | ELGLSIVVATTGALDM (SEQ ID NO: 2980) |
| 1074D11 | 1838 | 139 - 249 | 161 - 174 | 190 - 196 | 229 - 238 | 1 - 122 | 26 - 35 | 50 - 66 | 99 - 111 | ESEGGDYTNPFGY (SEQ ID NO: 2991) |
| 1074E05 | 1839 | 134 - 245 | 156 - 169 | 185 - 191 | 224 - 234 | 1 - 117 | 26 - 35 | 50 - 66 | 99 - 106 | DQGRYLDL (SEQ ID NO: 2175) |
| 1074E07 | 1840 | 141 - 251 | 163 - 175 | 191 - 197 | 230 - 240 | 1 - 124 | 26 - 34 | 49 - 65 | 98 - 113 | ELGLSIVGATTGALDM (SEQ ID NO: 2174) |
| 1074E09 | 1841 | 147 - 258 | 169 - 182 | 198 - 204 | 237 - 247 | 1 - 130 | 26 - 35 | 50 - 68 | 101 - 119 | DPGNYDILTGYYYYYGMDV (SEQ ID NO: 2935) |

| | | | | | | | | | | |
|---|---|---|---|---|---|---|---|---|---|---|
| 1074E11 | 1842 | 138 - 244 | 160 - 170 | 186 - 192 | 225 - 233 | 1 - 121 | 26 - 35 | 50 - 66 | 99 - 110 | VRLPHHHYFMAV (SEQ ID NO: 3075) |
| 1074H05 | 1843 | 144 - 254 | 166 - 178 | 194 - 200 | 233 - 243 | 1 - 126 | 26 - 35 | 50 - 66 | 99 - 115 | ESSITVNFPYYFYGMDV (SEQ ID NO: 3025) |
| 1075A03 | 1844 | 135 - 242 | 158 - 168 | 184 - 190 | 223 - 231 | 1 - 117 | 26 - 35 | 50 - 66 | 99 - 106 | DQGRYLDL (SEQ ID NO: 2175) |
| 1075A10 | 1845 | 135 - 244 | 157 - 169 | 185 - 191 | 224 - 233 | 1 - 117 | 26 - 35 | 50 - 66 | 99 - 106 | DQGRYLDL (SEQ ID NO: 2175) |
| 1075B07 | 1846 | 144 - 254 | 166 - 178 | 194 - 200 | 233 - 243 | 1 - 127 | 26 - 35 | 50 - 66 | 99 - 116 | SPEGDYQPLSSNYNWLDP (SEQ ID NO: 3011) |
| 1075D11 | 1847 | 134 - 246 | 156 - 169 | 185 - 191 | 224 - 235 | 1 - 117 | 26 - 36 | 51 - 66 | 99 - 106 | GKEGYNDN (SEQ ID NO: 3089) |
| 1075D12 | 1848 | 145 - 253 | 167 - 177 | 193 - 199 | 232 - 242 | 1 - 127 | 26 - 35 | 50 - 66 | 99 - 116 | GSGYDLLTGYFTGSPLDY (SEQ ID NO: 2766) |
| 1075G02 | 1849 | 144 - 255 | 166 - 179 | 195 - 201 | 234 - 244 | 1 - 127 | 26 - 35 | 50 - 66 | 99 - 116 | SPEGDYQPLSSNYNWLDP (SEQ ID NO: 3011) |
| 1075G09 | 1850 | 143 - 253 | 165 - 177 | 193 - 199 | 232 - 242 | 1 - 126 | 26 - 35 | 50 - 66 | 99 - 115 | MGHYDILTGYRHYGMDV (SEQ ID NO: 2831) |
| 1075G10 | 1851 | 140 - 250 | 162 - 174 | 190 - 196 | 229 - 239 | 1 - 122 | 26 - 35 | 50 - 66 | 99 - 111 | GNYDILTGYPHDL (SEQ ID NO: 3086) |
| 1075H05 | 1852 | 142 - 252 | 164 - 176 | 192 - 198 | 231 - 241 | 1 - 125 | 26 - 35 | 50 - 66 | 99 - 114 | SYYDILTGYYHTPLDY (SEQ ID NO: 2853) |
| 1075H07 | 1853 | 145 - 253 | 167 - 177 | 193 - 199 | 232 - 242 | 1 - 127 | 26 - 35 | 50 - 66 | 99 - 116 | GSGYDLLTGYFTGSPLDY (SEQ ID NO: 2766) |
| 1076A11 | 1854 | 142 - 254 | 164 - 177 | 193 - 199 | 232 - 243 | 1 - 125 | 26 - 35 | 50 - 66 | 99 - 114 | DDRDILTNYYLEYFQH (SEQ ID NO: 2868) |
| 1076A12 | 1855 | 144 - 256 | 166 - 178 | 194 - 200 | 233 - 245 | 1 - 127 | 26 - 35 | 50 - 66 | 99 - 116 | GSGYDVLTGYFTGSPLDY (SEQ ID NO: 3057) |
| 1076B06 | 1856 | 142 - 249 | 164 - 174 | 190 - 196 | 229 - 238 | 1 - 124 | 26 - 35 | 50 - 66 | 99 - 113 | GRYDILTGYFTSFDY (SEQ ID NO: 3066) |
| 1076B10 | 1857 | 142 - 254 | 164 - 177 | 193 - 199 | 232 - 243 | 1 - 125 | 26 - 35 | 50 - 66 | 99 - 114 | DDRDILTNYYLEYFQH (SEQ ID NO: 2868) |
| 1076B12 | 1858 | 145 - 253 | 167 - 177 | 193 - 199 | 232 - 242 | 1 - 127 | 26 - 35 | 50 - 66 | 99 - 116 | GTGYDILTGYYMGSAFDQ (SEQ ID NO: 2800) |
| 1076C06 | 1859 | 143 - 253 | 165 - 177 | 193 - 199 | 232 - 242 | 1 - 126 | 26 - 35 | 50 - 66 | 99 - 115 | MGHYDILTGYRHYGMDV (SEQ ID NO: 2831) |
| 1076C11 | 1860 | 134 - 245 | 156 - 168 | 184 - 190 | 223 - 234 | 1 - 117 | 26 - 35 | 50 - 66 | 99 - 106 | DQGRYLDL (SEQ ID NO: 2175) |
| 1076D06 | 1861 | 141 - 252 | 163 - 176 | 192 - 198 | 231 - 241 | 1 - 124 | 26 - 34 | 49 - 65 | 98 - 113 | ELGLSIVGATTGALDM (SEQ ID NO: 2174) |
| 1076E05 | 1862 | 144 - 255 | 166 - 179 | 195 - 201 | 234 - 244 | 1 - 127 | 26 - 35 | 50 - 66 | 99 - 116 | GTGYDILTGYYMGSAFDQ (SEQ ID NO: 2800) |
| 1076E08 | 1863 | 135 - 243 | 157 - 167 | 183 - 189 | 222 - 232 | 1 - 117 | 26 - 35 | 50 - 66 | 99 - 106 | DQGRYLDL (SEQ ID NO: 2175) |
| 1076F05 | 1864 | 134 - 245 | 156 - 169 | 185 - 191 | 224 - 234 | 1 - 117 | 26 - 36 | 51 - 66 | 99 - 106 | RDVQGAPY (SEQ ID NO: 3088) |
| 1076G01 | 1865 | 144 - 254 | 166 - 178 | 194 - 200 | 233 - 243 | 1 - 127 | 26 - 35 | 50 - 66 | 99 - 116 | VEGVYDILTGYSFDAFDI (SEQ ID NO: 3078) |
| 1076H01 | 1866 | 146 - 254 | 168 - 178 | 194 - 200 | 233 - 243 | 1 - 128 | 26 - 35 | 50 - 66 | 99 - 117 | EQGYDILTGYYFEGGWFDP (SEQ ID NO: 2834) |
| 1076H03 | 1867 | 142 - 250 | 164 - 174 | 190 - 196 | 229 - 239 | 1 - 124 | 26 - 34 | 49 - 65 | 98 - 113 | ELGLSIVGATTGALDM (SEQ ID NO: 2174) |
| 1077B05 | 1868 | 147 - 257 | 169 - 182 | 198 - 204 | 237 - 246 | 1 - 131 | 26 - 37 | 52 - 69 | 102 - 120 | DKSYYDILTGYYYYYGMDV (SEQ ID NO: 3052) |
| 1077C10 | 1869 | 141 - 251 | 163 - 176 | 192 - 198 | 231 - 240 | 1 - 125 | 26 - 35 | 50 - 66 | 99 - 114 | MEYDILTGYYGGYFDY (SEQ ID NO: 2179) |
| 1077D01 | 1870 | 141 - 251 | 163 - 176 | 192 - 198 | 231 - 240 | 1 - 125 | 26 - 35 | 50 - 66 | 99 - 114 | MEYDILTGYYGGYFDY (SEQ ID NO: 2179) |
| 1077D04 | 1871 | 141 - 248 | 162 - 172 | 188 - 194 | 227 - 237 | 1 - 125 | 26 - 35 | 50 - 66 | 99 - 114 | MEYDILTGYYGGYFDY (SEQ ID NO: 2179) |
| 1077D11 | 1872 | 141 - 251 | 163 - 176 | 192 - 198 | 231 - 240 | 1 - 125 | 26 - 35 | 50 - 66 | 99 - 114 | MEYDILTGYYGGYFDY (SEQ ID NO: 2179) |
| 1077D12 | 1873 | 140 - 247 | 161 - 171 | 187 - 193 | 226 - 236 | 1 - 124 | 26 - 35 | 50 - 66 | 99 - 113 | EKYDILTGYYDAFDI (SEQ ID NO: 3046) |
| 1077E01 | 1874 | 142 - 252 | 164 - 177 | 193 - 199 | 232 - 241 | 1 - 126 | 26 - 35 | 50 - 66 | 99 - 115 | EMGYDILTGYYLNYMDV (SEQ ID NO: 2862) |
| 1077E03 | 1875 | 142 - 252 | 164 - 177 | 193 - 199 | 232 - 241 | 1 - 126 | 26 - 35 | 50 - 66 | 99 - 115 | EMGYDILTGYYLNYMDV (SEQ ID NO: 2862) |
| 1077E08 | 1876 | 141 - 248 | 164 - 174 | 190 - 196 | 229 - 237 | 1 - 125 | 26 - 35 | 50 - 66 | 99 - 114 | MEYDILTGYYGGYFDY (SEQ ID NO: 2179) |
| 1077F05 | 1877 | 141 - 248 | 162 - 172 | 188 - 194 | 227 - 237 | 1 - 125 | 26 - 35 | 50 - 66 | 99 - 114 | MEYDILTGYYGGYFDY (SEQ ID NO: 2179) |
| 1077G05 | 1878 | 141 - 251 | 163 - 176 | 192 - 198 | 231 - 240 | 1 - 125 | 26 - 35 | 50 - 66 | 99 - 114 | MEYDILTGYYGGYFDY (SEQ ID NO: 2179) |
| 1077H02 | 1879 | 141 - 248 | 164 - 174 | 190 - 196 | 229 - 237 | 1 - 125 | 26 - 35 | 50 - 66 | 99 - 114 | MEYDILTGYYGGYFDY (SEQ ID NO: 2179) |
| 1078B05 | 1880 | 143 - 253 | 165 - 178 | 194 - 200 | 233 - 242 | 1 - 127 | 26 - 35 | 50 - 66 | 99 - 116 | ESHYDILTGYYSNFSFDI (SEQ ID NO: 2994) |
| 1079E02 | 1881 | 137 - 244 | 160 - 170 | 186 - 192 | 225 - 233 | 1 - 121 | 26 - 35 | 50 - 66 | 99 - 110 | DSGSYYYDAFDI (SEQ ID NO: 2194) |
| 1079F11 | 1882 | 132 - 239 | 155 - 165 | 181 - 187 | 220 - 228 | 1 - 116 | 26 - 35 | 50 - 66 | 99 - 105 | TGSGFDY (SEQ ID NO: 2192) |
| 1082G02 | 1883 | 136 - 243 | 159 - 169 | 185 - 191 | 224 - 232 | 1 - 120 | 26 - 35 | 50 - 66 | 99 - 109 | DGYRTNDALDI (SEQ ID NO: 2191) |

| | | | | | | | | | | |
|---|---|---|---|---|---|---|---|---|---|---|
| 1082H08 | 1884 | 132 - 242 | 154 - 167 | 183 - 189 | 222 - 231 | 1 - 115 | 26 - 35 | 50 - 66 | 99 - 104 | DWDMDV (SEQ ID NO: 2193) |
| 1099D03 | 1885 | 137 - 247 | 159 - 172 | 188 - 194 | 227 - 236 | 1 - 120 | 26 - 35 | 50 - 66 | 99 - 109 | DNGGGTIGFDY (SEQ ID NO: 2195) |
| 1079B05 | 1886 | 130 - 240 | 152 - 165 | 181 - 187 | 220 - 229 | 1 - 114 | 26 - 35 | 50 - 66 | 99 - 103 | FVLDY (SEQ ID NO: 2210) |
| 1079B12 | 1887 | 134 - 241 | 157 - 167 | 183 - 189 | 222 - 230 | 1 - 118 | 26 - 35 | 50 - 66 | 99 - 107 | WTSSGAFDI (SEQ ID NO: 2205) |
| 1079C01 | 1888 | 131 - 241 | 153 - 166 | 182 - 188 | 221 - 230 | 1 - 115 | 26 - 35 | 50 - 66 | 99 - 104 | DWDMDV (SEQ ID NO: 2193) |
| 1079F06 | 1889 | 134 - 241 | 157 - 167 | 183 - 189 | 222 - 230 | 1 - 118 | 26 - 35 | 50 - 66 | 99 - 107 | DNLHAAFDI (SEQ ID NO: 2202) |
| 1079F08 | 1890 | 138 - 248 | 160 - 172 | 188 - 194 | 227 - 237 | 1 - 122 | 26 - 35 | 50 - 66 | 99 - 111 | YYYHSSGSDAFDI (SEQ ID NO: 2206) |
| 1080A03 | 1891 | 139 - 249 | 161 - 173 | 189 - 195 | 228 - 238 | 1 - 122 | 26 - 35 | 50 - 66 | 99 - 111 | VGIKAAAVDNFEY (SEQ ID NO: 2197) |
| 1080A08 | 1892 | 136 - 247 | 158 - 171 | 187 - 193 | 226 - 236 | 1 - 119 | 26 - 35 | 50 - 66 | 99 - 108 | VHSTGYAFEN (SEQ ID NO: 2209) |
| 1080B01 | 1893 | 144 - 254 | 166 - 178 | 194 - 200 | 233 - 243 | 1 - 126 | 26 - 35 | 50 - 66 | 99 - 115 | EYSGYHYVEGGSYAMDV (SEQ ID NO: 2201) |
| 1080D03 | 1894 | 139 - 249 | 161 - 173 | 189 - 195 | 228 - 238 | 1 - 122 | 26 - 35 | 50 - 66 | 99 - 111 | VGIKAAAVDNFEY (SEQ ID NO: 2197) |
| 1080E05 | 1895 | 142 - 253 | 164 - 177 | 193 - 199 | 232 - 242 | 1 - 123 | 26 - 35 | 50 - 66 | 99 - 114 | EGGGDAYDVAPYYFDY (SEQ ID NO: 2204) |
| 1080G07 | 1896 | 138 - 245 | 161 - 172 | 188 - 194 | 227 - 234 | 1 - 120 | 26 - 35 | 50 - 66 | 99 - 109 | EGPGYYYGMDV (SEQ ID NO: 2209) |
| 1080G09 | 1897 | 137 - 249 | 159 - 172 | 188 - 194 | 227 - 238 | 1 - 120 | 26 - 35 | 50 - 66 | 99 - 109 | DNGGGTIGFDY (SEQ ID NO: 2195) |
| 1082A05 | 1898 | 131 - 240 | 153 - 165 | 181 - 187 | 220 - 229 | 1 - 115 | 26 - 35 | 50 - 66 | 99 - 104 | DLDFDY (SEQ ID NO: 2208) |
| 1082B08 | 1899 | 137 - 247 | 159 - 171 | 187 - 193 | 226 - 236 | 1 - 121 | 26 - 35 | 50 - 66 | 99 - 110 | DLGIAGTIYFDY (SEQ ID NO: 2207) |
| 1082C03 | 1900 | 138 - 245 | 161 - 171 | 187 - 193 | 226 - 234 | 1 - 122 | 26 - 35 | 50 - 66 | 99 - 111 | DASRDIVVLPLAI (SEQ ID NO: 2198) |
| 1082D07 | 1901 | 134 - 241 | 157 - 167 | 183 - 189 | 222 - 230 | 1 - 118 | 26 - 35 | 50 - 66 | 99 - 107 | WTSSGAFDI (SEQ ID NO: 2205) |
| 1082G01 | 1902 | 138 - 245 | 161 - 171 | 187 - 193 | 226 - 234 | 1 - 122 | 26 - 35 | 50 - 66 | 99 - 111 | DRGSGWPNWYFDL (SEQ ID NO: 2212) |
| 1083B12 | 1903 | 139 - 247 | 161 - 171 | 187 - 193 | 226 - 236 | 1 - 121 | 26 - 35 | 50 - 66 | 99 - 110 | ESGAGGYYYDDY (SEQ ID NO: 2196) |
| 1083G03 | 1904 | 139 - 249 | 161 - 173 | 189 - 195 | 228 - 238 | 1 - 122 | 26 - 35 | 50 - 66 | 99 - 111 | VGIKAAAVDNFEY (SEQ ID NO: 2197) |
| 1084A01 | 1905 | 130 - 240 | 152 - 164 | 180 - 186 | 219 - 229 | 1 - 114 | 26 - 35 | 50 - 66 | 99 - 103 | DTTDY (SEQ ID NO: 2203) |
| 1084B02 | 1906 | 130 - 237 | 153 - 163 | 179 - 185 | 218 - 226 | 1 - 114 | 26 - 35 | 50 - 66 | 99 - 103 | DTTDY (SEQ ID NO: 2203) |
| 1084C04 | 1907 | 131 - 238 | 152 - 162 | 178 - 184 | 217 - 227 | 1 - 115 | 25 - 34 | 49 - 65 | 98 - 104 | NLWGLDY (SEQ ID NO: 2199) |
| 1084C11 | 1908 | 134 - 244 | 156 - 169 | 185 - 191 | 224 - 233 | 1 - 118 | 26 - 35 | 50 - 66 | 99 - 107 | GNAWGAFDI (SEQ ID NO: 2211) |
| 1079A01 | 1909 | 134 - 243 | 155 - 168 | 184 - 190 | 223 - 232 | 1 - 118 | 26 - 35 | 50 - 66 | 99 - 107 | EGVAAGEDY (SEQ ID NO: 3123) |
| 1079A03 | 1910 | 134 - 244 | 156 - 169 | 185 - 191 | 224 - 233 | 1 - 118 | 26 - 35 | 50 - 66 | 99 - 107 | GGMDWDFDY (SEQ ID NO: 3183) |
| 1079A04 | 1911 | 134 - 241 | 155 - 165 | 181 - 187 | 220 - 230 | 1 - 118 | 26 - 35 | 50 - 66 | 99 - 107 | VDSSGYAYY (SEQ ID NO: 3213) |
| 1079A06 | 1912 | 133 - 240 | 154 - 164 | 180 - 186 | 219 - 229 | 1 - 117 | 26 - 35 | 50 - 66 | 99 - 106 | DAAVTAEG (SEQ ID NO: 3142) |
| 1079A07 | 1913 | 136 - 246 | 158 - 170 | 186 - 192 | 225 - 235 | 1 - 120 | 26 - 35 | 50 - 66 | 99 - 109 | GSNYSPDAFDI (SEQ ID NO: 3112) |
| 1079A10 | 1914 | 148 - 255 | 169 - 179 | 195 - 201 | 234 - 244 | 1 - 132 | 26 - 35 | 50 - 68 | 101 - 121 | LPFDLRYCTGGICPGFDWLGP (SEQ ID NO: 3163) |
| 1079A11 | 1915 | 135 - 242 | 158 - 168 | 184 - 190 | 223 - 231 | 1 - 119 | 26 - 35 | 50 - 66 | 99 - 108 | GPSYYYYMAV (SEQ ID NO: 3114) |
| 1079B02 | 1916 | 134 - 243 | 156 - 168 | 184 - 190 | 223 - 232 | 1 - 118 | 26 - 35 | 50 - 66 | 99 - 107 | EGVAAGEDY (SEQ ID NO: 3123) |
| 1079B03 | 1917 | 136 - 246 | 158 - 170 | 186 - 192 | 225 - 235 | 1 - 120 | 26 - 35 | 50 - 66 | 99 - 109 | GSNYSPDAFDI (SEQ ID NO: 3112) |
| 1079B04 | 1918 | 130 - 240 | 152 - 165 | 181 - 187 | 220 - 229 | 1 - 114 | 26 - 35 | 50 - 66 | 99 - 103 | LLSDY (SEQ ID NO: 3168) |
| 1079B07 | 1919 | 138 - 245 | 159 - 169 | 185 - 191 | 224 - 234 | 1 - 122 | 26 - 35 | 50 - 66 | 99 - 111 | DLSGSYFSRYFDY (SEQ ID NO: 3193) |
| 1079B09 | 1920 | 139 - 246 | 162 - 172 | 188 - 194 | 227 - 235 | 1 - 123 | 26 - 35 | 50 - 66 | 99 - 112 | VEWEDIVVGSAFDI (SEQ ID NO: 3128) |
| 1079C02 | 1921 | 144 - 251 | 167 - 177 | 193 - 199 | 232 - 240 | 1 - 128 | 26 - 35 | 50 - 66 | 99 - 117 | VTSLYSSSSGGYYYYGMDV (SEQ ID NO: 3145) |
| 1079C04 | 1922 | 132 - 239 | 155 - 165 | 181 - 187 | 220 - 228 | 1 - 116 | 26 - 35 | 50 - 66 | 99 - 105 | GWRGVDY (SEQ ID NO: 3195) |
| 1079C05 | 1923 | 140 - 247 | 163 - 173 | 189 - 195 | 228 - 236 | 1 - 124 | 26 - 35 | 50 - 66 | 99 - 113 | AGGNPRSGSLVYFDY (SEQ ID NO: 3225) |
| 1079C07 | 1924 | 137 - 244 | 158 - 168 | 184 - 190 | 223 - 233 | 1 - 121 | 26 - 35 | 50 - 66 | 99 - 110 | GLDVYAIYGLDV (SEQ ID NO: 3176) |
| 1079D01 | 1925 | 144 - 254 | 166 - 179 | 195 - 201 | 234 - 243 | 1 - 128 | 26 - 35 | 50 - 66 | 99 - 117 | EVRNYDLLTRSYLAGPLDN (SEQ ID NO: 2751) |

| | | | | | | | | | | |
|---|---|---|---|---|---|---|---|---|---|---|
| 1079D02 | 1926 | 135 - 245 | 157 - 169 | 185 - 191 | 224 - 234 | 1 - 119 | 26 - 35 | 50 - 66 | 99 - 108 | EIGWEGAFDI (SEQ ID NO: 3178) |
| 1079D04 | 1927 | 133 - 243 | 155 - 167 | 183 - 189 | 222 - 232 | 1 - 117 | 26 - 35 | 50 - 66 | 99 - 106 | VRPGLMDV (SEQ ID NO: 3132) |
| 1079D06 | 1928 | 137 - 247 | 159 - 171 | 187 - 193 | 226 - 236 | 1 - 121 | 26 - 35 | 50 - 66 | 99 - 110 | EAYTSSWAEFDF (SEQ ID NO: 3190) |
| 1079D07 | 1929 | 136 - 243 | 157 - 167 | 183 - 189 | 222 - 232 | 1 - 120 | 26 - 35 | 50 - 66 | 99 - 109 | NITPLAMVGDF (SEQ ID NO: 3146) |
| 1079D08 | 1930 | 130 - 240 | 152 - 165 | 181 - 187 | 220 - 229 | 1 - 114 | 26 - 35 | 50 - 66 | 99 - 103 | LIEDF (SEQ ID NO: 3161) |
| 1079D09 | 1931 | 131 - 238 | 152 - 162 | 178 - 184 | 217 - 227 | 1 - 115 | 26 - 35 | 50 - 66 | 99 - 104 | DSGSPD (SEQ ID NO: 3108) |
| 1079D11 | 1932 | 134 - 241 | 157 - 167 | 183 - 189 | 222 - 230 | 1 - 118 | 26 - 35 | 50 - 66 | 99 - 107 | EGVAAGEDY (SEQ ID NO: 3123) |
| 1079E06 | 1933 | 136 - 244 | 158 - 168 | 184 - 190 | 223 - 233 | 1 - 120 | 26 - 35 | 50 - 66 | 99 - 109 | EKRGSRRVFDI (SEQ ID NO: 3093) |
| 1079E08 | 1934 | 137 - 247 | 159 - 171 | 187 - 193 | 226 - 236 | 1 - 121 | 26 - 35 | 50 - 66 | 99 - 110 | EAYASSWAEFDF (SEQ ID NO: 3189) |
| 1079E11 | 1935 | 136 - 243 | 159 - 169 | 185 - 191 | 224 - 232 | 1 - 120 | 26 - 35 | 50 - 66 | 99 - 109 | PYGSGSYAFDI (SEQ ID NO: 3185) |
| 1079E12 | 1936 | 143 - 253 | 165 - 177 | 193 - 199 | 232 - 242 | 1 - 127 | 26 - 35 | 50 - 66 | 99 - 116 | ARDYYDSSGYYVFDAFDI (SEQ ID NO: 3107) |
| 1079F01 | 1937 | 133 - 241 | 154 - 164 | 180 - 186 | 219 - 230 | 1 - 117 | 26 - 35 | 50 - 66 | 99 - 106 | GHFYGMDV (SEQ ID NO: 3098) |
| 1079F02 | 1938 | 148 - 253 | 169 - 179 | 195 - 201 | 234 - 242 | 1 - 132 | 26 - 35 | 50 - 68 | 101 - 121 | LPPDLRYCDGGMCSGFDWLGP (SEQ ID NO: 3219) |
| 1079F03 | 1939 | 140 - 247 | 161 - 171 | 187 - 193 | 226 - 236 | 1 - 124 | 26 - 35 | 50 - 66 | 99 - 113 | ESLLTEEYCGSDCYS (SEQ ID NO: 3115) |
| 1079F04 | 1940 | 136 - 243 | 157 - 167 | 183 - 189 | 222 - 232 | 1 - 120 | 26 - 35 | 50 - 66 | 99 - 109 | NSAPPAFSMDV (SEQ ID NO: 3099) |
| 1079F09 | 1941 | 130 - 237 | 151 - 161 | 177 - 183 | 216 - 226 | 1 - 114 | 26 - 35 | 50 - 66 | 99 - 103 | RYYDY (SEQ ID NO: 3139) |
| 1079F10 | 1942 | 136 - 243 | 157 - 167 | 183 - 189 | 222 - 232 | 1 - 120 | 26 - 35 | 50 - 66 | 99 - 109 | NITPLAMVGDF (SEQ ID NO: 3146) |
| 1079F12 | 1943 | 136 - 243 | 159 - 169 | 185 - 191 | 224 - 232 | 1 - 120 | 26 - 35 | 50 - 66 | 99 - 109 | ADYSNDYYMDV (SEQ ID NO: 3166) |
| 1079G02 | 1944 | 136 - 243 | 157 - 167 | 183 - 189 | 222 - 232 | 1 - 120 | 26 - 35 | 50 - 66 | 99 - 109 | NITPLAMVGDF (SEQ ID NO: 3146) |
| 1079G05 | 1945 | 136 - 243 | 159 - 169 | 185 - 191 | 224 - 232 | 1 - 120 | 26 - 35 | 50 - 66 | 99 - 109 | FPLESYYYMDV (SEQ ID NO: 3124) |
| 1079G06 | 1946 | 135 - 245 | 157 - 170 | 186 - 192 | 225 - 234 | 1 - 119 | 26 - 35 | 50 - 66 | 99 - 108 | GNSFGRTLDY (SEQ ID NO: 3158) |
| 1079H03 | 1947 | 136 - 243 | 157 - 167 | 183 - 189 | 222 - 232 | 1 - 120 | 26 - 35 | 50 - 66 | 99 - 109 | DVPPPDGYLEV (SEQ ID NO: 3192) |
| 1079H05 | 1948 | 134 - 241 | 157 - 167 | 183 - 189 | 222 - 230 | 1 - 118 | 26 - 35 | 50 - 66 | 99 - 107 | ASYFVPFDY (SEQ ID NO: 3171) |
| 1080A01 | 1949 | 132 - 242 | 154 - 166 | 182 - 188 | 221 - 231 | 1 - 115 | 26 - 35 | 50 - 66 | 99 - 104 | GGWLDD (SEQ ID NO: 3210) |
| 1080A02 | 1950 | 134 - 245 | 156 - 169 | 185 - 191 | 224 - 234 | 1 - 117 | 26 - 35 | 50 - 66 | 99 - 106 | EHSSSFDY (SEQ ID NO: 3111) |
| 1080A05 | 1951 | 142 - 253 | 164 - 177 | 193 - 199 | 232 - 242 | 1 - 125 | 26 - 35 | 50 - 66 | 99 - 114 | EGEGDGYNVAPYYFDY (SEQ ID NO: 3160) |
| 1080A06 | 1952 | 143 - 250 | 166 - 176 | 192 - 198 | 231 - 239 | 1 - 125 | 26 - 35 | 50 - 66 | 99 - 114 | EAGGSGSYHFSFPFDY (SEQ ID NO: 3188) |
| 1080A07 | 1953 | 136 - 247 | 158 - 171 | 187 - 193 | 226 - 236 | 1 - 119 | 26 - 35 | 50 - 66 | 99 - 108 | TGIWGYYFDY (SEQ ID NO: 3175) |
| 1080A10 | 1954 | 142 - 252 | 164 - 176 | 192 - 198 | 231 - 241 | 1 - 125 | 26 - 35 | 50 - 66 | 99 - 114 | DGNLNYDGSTDYGMDV (SEQ ID NO: 3140) |
| 1080B02 | 1955 | 140 - 248 | 162 - 172 | 188 - 194 | 227 - 237 | 1 - 122 | 26 - 35 | 50 - 66 | 99 - 111 | LGRNYTSSWSLDY (SEQ ID NO: 3181) |
| 1080B03 | 1956 | 139 - 249 | 161 - 173 | 189 - 195 | 228 - 238 | 1 - 122 | 26 - 35 | 50 - 66 | 99 - 111 | VVGGYSSTLGIDY (SEQ ID NO: 3096) |
| 1080B05 | 1957 | 139 - 249 | 161 - 173 | 189 - 195 | 228 - 238 | 1 - 121 | 26 - 35 | 50 - 66 | 99 - 110 | LGVARGREAFDL (SEQ ID NO: 3206) |
| 1080B06 | 1958 | 143 - 254 | 165 - 177 | 193 - 199 | 232 - 243 | 1 - 126 | 26 - 37 | 52 - 69 | 102 - 115 | AVRSPGYYYYYMDV (SEQ ID NO: 3125) |
| 1080B07 | 1959 | 135 - 243 | 157 - 167 | 183 - 189 | 223 - 232 | 1 - 117 | 26 - 35 | 50 - 66 | 99 - 106 | GRKPLFDY (SEQ ID NO: 3141) |
| 1080B08 | 1960 | 137 - 248 | 159 - 172 | 188 - 194 | 227 - 237 | 1 - 120 | 26 - 37 | 52 - 67 | 100 - 109 | KQRREKYFDY (SEQ ID NO: 3100) |
| 1080B09 | 1961 | 143 - 254 | 165 - 178 | 194 - 200 | 233 - 243 | 1 - 126 | 26 - 35 | 50 - 66 | 99 - 115 | EKAIIETTSGEADPFDI (SEQ ID NO: 3151) |
| 1080B10 | 1962 | 139 - 249 | 161 - 173 | 189 - 195 | 228 - 238 | 1 - 122 | 26 - 37 | 52 - 67 | 100 - 111 | RPALRSLWYFDL (SEQ ID NO: 3102) |
| 1080B11 | 1963 | 138 - 248 | 160 - 172 | 188 - 194 | 227 - 237 | 1 - 121 | 26 - 35 | 50 - 68 | 101 - 110 | LECTGGSCGF (SEQ ID NO: 3186) |
| 1080B12 | 1964 | 141 - 253 | 164 - 179 | 195 - 201 | 234 - 242 | 1 - 123 | 26 - 35 | 50 - 66 | 99 - 112 | NPYYYDSSEGFFDY (SEQ ID NO: 3109) |
| 1080C03 | 1965 | 140 - 248 | 162 - 172 | 188 - 194 | 227 - 237 | 1 - 122 | 26 - 35 | 50 - 66 | 99 - 111 | SGRQAYYYYGMDV (SEQ ID NO: 3091) |
| 1080C06 | 1966 | 146 - 254 | 168 - 178 | 194 - 200 | 233 - 243 | 1 - 128 | 26 - 36 | 51 - 66 | 99 - 117 | DYYDGSSYSSGDYYYYMDV (SEQ ID NO: 3227) |
| 1080C07 | 1967 | 145 - 256 | 167 - 180 | 196 - 202 | 235 - 245 | 1 - 128 | 26 - 35 | 50 - 66 | 99 - 117 | DSDLVVIPTAIQGRYYFDN (SEQ ID NO: 3113) |

| | | | | | | | | | | |
|---|---|---|---|---|---|---|---|---|---|---|
| 1080C08 | 1968 | 138 - 249 | 160 - 173 | 189 - 195 | 228 - 238 | 1 - 121 | 26 - 35 | 50 - 66 | 99 - 110 | GKRYSYGWYFDI (SEQ ID NO: 3130) |
| 1080C10 | 1969 | 132 - 243 | 154 - 167 | 183 - 189 | 222 - 232 | 1 - 115 | 26 - 35 | 50 - 66 | 99 - 104 | DTPLDP (SEQ ID NO: 3094) |
| 1080C11 | 1970 | 138 - 249 | 160 - 173 | 189 - 195 | 228 - 238 | 1 - 121 | 26 - 35 | 50 - 66 | 99 - 110 | EGDPTDNDAFDV (SEQ ID NO: 3155) |
| 1080C12 | 1971 | 139 - 249 | 161 - 173 | 189 - 195 | 228 - 238 | 1 - 122 | 26 - 35 | 50 - 66 | 99 - 111 | DGPTYARPYYLDH (SEQ ID NO: 3153) |
| 1080D01 | 1972 | 138 - 245 | 161 - 171 | 187 - 193 | 226 - 234 | 1 - 120 | 26 - 35 | 50 - 66 | 99 - 109 | DGTKYDWGFDY (SEQ ID NO: 3220) |
| 1080D02 | 1973 | 142 - 254 | 164 - 177 | 193 - 199 | 232 - 243 | 1 - 125 | 26 - 35 | 50 - 66 | 99 - 114 | ETFSHCSGGSCYPFDY (SEQ ID NO: 3212) |
| 1080D04 | 1974 | 140 - 248 | 162 - 172 | 188 - 194 | 227 - 237 | 1 - 122 | 26 - 35 | 50 - 66 | 99 - 111 | SQRQAYYYYGMDV (SEQ ID NO: 3091) |
| 1080D05 | 1975 | 138 - 246 | 160 - 170 | 186 - 192 | 225 - 235 | 1 - 120 | 26 - 35 | 50 - 66 | 99 - 109 | EFFGYVYLTDY (SEQ ID NO: 3165) |
| 1080D08 | 1976 | 138 - 248 | 160 - 172 | 188 - 194 | 227 - 237 | 1 - 121 | 26 - 35 | 50 - 68 | 101 - 110 | LHCTGGSCGF (SEQ ID NO: 3186) |
| 1080D09 | 1977 | 139 - 250 | 161 - 174 | 190 - 196 | 229 - 239 | 1 - 122 | 26 - 35 | 50 - 66 | 99 - 111 | VDYTDYEMGAFEI (SEQ ID NO: 3187) |
| 1080D11 | 1978 | 136 - 247 | 158 - 171 | 187 - 193 | 226 - 236 | 1 - 119 | 26 - 35 | 50 - 66 | 99 - 108 | VGNFGYYFEY (SEQ ID NO: 3196) |
| 1080D12 | 1979 | 137 - 245 | 159 - 169 | 185 - 191 | 224 - 234 | 1 - 119 | 26 - 35 | 50 - 68 | 101 - 108 | SSRNGGDY (SEQ ID NO: 3214) |
| 1080E01 | 1980 | 138 - 246 | 160 - 170 | 186 - 192 | 225 - 235 | 1 - 120 | 26 - 35 | 50 - 66 | 99 - 109 | DLSRVAGRFDY (SEQ ID NO: 3164) |
| 1080E04 | 1981 | 137 - 247 | 159 - 171 | 187 - 193 | 226 - 236 | 1 - 120 | 26 - 37 | 52 - 67 | 100 - 109 | HDVYGDLFDY (SEQ ID NO: 3211) |
| 1080E06 | 1982 | 138 - 248 | 160 - 172 | 188 - 194 | 227 - 237 | 1 - 121 | 26 - 35 | 50 - 68 | 101 - 110 | LHCSGGSCGF (SEQ ID NO: 3221) |
| 1080E07 | 1983 | 143 - 254 | 165 - 178 | 194 - 200 | 233 - 243 | 1 - 126 | 26 - 35 | 50 - 66 | 99 - 115 | EGSIVGATLTINDAFDI (SEQ ID NO: 3150) |
| 1080E08 | 1984 | 138 - 249 | 160 - 173 | 189 - 195 | 228 - 238 | 1 - 121 | 26 - 35 | 50 - 66 | 99 - 110 | GKRYSYGWYFDI (SEQ ID NO: 3130) |
| 1080E12 | 1985 | 132 - 242 | 154 - 166 | 182 - 188 | 221 - 231 | 1 - 114 | 26 - 35 | 50 - 66 | 99 - 103 | DPFDY (SEQ ID NO: 3134) |
| 1080F04 | 1986 | 139 - 249 | 161 - 173 | 189 - 195 | 228 - 238 | 1 - 122 | 26 - 35 | 50 - 66 | 99 - 111 | DGPTYARPYYLDH (SEQ ID NO: 3153) |
| 1080F05 | 1987 | 143 - 253 | 165 - 177 | 193 - 199 | 232 - 242 | 1 - 126 | 26 - 35 | 50 - 66 | 99 - 115 | ESSGTLGEFSLELPFDY (SEQ ID NO: 3203) |
| 1080F06 | 1988 | 140 - 248 | 162 - 172 | 188 - 194 | 227 - 237 | 1 - 122 | 26 - 35 | 50 - 66 | 99 - 111 | LGRNYTSSWSLDY (SEQ ID NO: 3181) |
| 1080F08 | 1989 | 132 - 240 | 154 - 164 | 180 - 186 | 219 - 229 | 1 - 114 | 26 - 35 | 50 - 66 | 99 - 103 | NAFDY (SEQ ID NO: 3121) |
| 1080G03 | 1990 | 142 - 250 | 164 - 174 | 190 - 196 | 229 - 239 | 1 - 124 | 26 - 36 | 51 - 66 | 99 - 113 | GRGYSSSSSVYGMDI (SEQ ID NO: 3095) |
| 1080G04 | 1991 | 133 - 244 | 156 - 171 | 187 - 193 | 226 - 233 | 1 - 115 | 26 - 35 | 50 - 66 | 99 - 104 | VHSSGS (SEQ ID NO: 3216) |
| 1080G10 | 1992 | 145 - 252 | 167 - 177 | 193 - 199 | 232 - 241 | 1 - 127 | 26 - 35 | 50 - 66 | 99 - 116 | KRGDFGVIRLHHYYGMDV (SEQ ID NO: 3136) |
| 1080G11 | 1993 | 137 - 247 | 159 - 171 | 187 - 193 | 226 - 236 | 1 - 120 | 26 - 37 | 52 - 67 | 100 - 109 | HDVYGDLFDS (SEQ ID NO: 3205) |
| 1080H01 | 1994 | 142 - 252 | 164 - 176 | 192 - 198 | 231 - 241 | 1 - 124 | 26 - 37 | 52 - 67 | 100 - 113 | LRPDADYGDYGFDY (SEQ ID NO: 3218) |
| 1080H02 | 1995 | 140 - 248 | 162 - 172 | 188 - 194 | 227 - 237 | 1 - 123 | 26 - 35 | 50 - 66 | 99 - 112 | TSERGTYRQWDFDN (SEQ ID NO: 3204) |
| 1080H03 | 1996 | 136 - 246 | 158 - 170 | 186 - 192 | 225 - 235 | 1 - 119 | 26 - 35 | 50 - 66 | 99 - 108 | EAGEVAAIDY (SEQ ID NO: 3180) |
| 1080H04 | 1997 | 138 - 249 | 160 - 173 | 189 - 195 | 228 - 238 | 1 - 121 | 26 - 35 | 50 - 66 | 99 - 110 | GKRYSYGWYFDI (SEQ ID NO: 3130) |
| 1080H05 | 1998 | 137 - 247 | 159 - 171 | 187 - 193 | 226 - 236 | 1 - 120 | 26 - 37 | 52 - 67 | 100 - 109 | HDVYGDLFDS (SEQ ID NO: 3205) |
| 1080H06 | 1999 | 138 - 249 | 160 - 173 | 189 - 195 | 228 - 238 | 1 - 121 | 26 - 35 | 50 - 66 | 99 - 110 | GKRYSYGWYFDV (SEQ ID NO: 3217) |
| 1080H07 | 2000 | 138 - 248 | 160 - 172 | 188 - 194 | 227 - 237 | 1 - 121 | 26 - 35 | 50 - 68 | 101 - 110 | LHCTGGSCGF (SEQ ID NO: 3186) |
| 1080H08 | 2001 | 140 - 251 | 162 - 175 | 191 - 197 | 230 - 240 | 1 - 122 | 26 - 35 | 50 - 66 | 99 - 111 | ERGGRDGDYALDF (SEQ ID NO: 3148) |
| 1080H09 | 2002 | 141 - 249 | 163 - 173 | 189 - 195 | 228 - 238 | 1 - 123 | 26 - 36 | 51 - 66 | 99 - 112 | RTPDHNGDSGPPDY (SEQ ID NO: 3215) |
| 1081A01 | 2003 | 130 - 237 | 153 - 163 | 179 - 185 | 218 - 226 | 1 - 114 | 26 - 35 | 50 - 66 | 99 - 103 | DTTDY (SEQ ID NO: 2203) |
| 1081A03 | 2004 | 135 - 245 | 157 - 170 | 186 - 192 | 225 - 234 | 1 - 119 | 26 - 35 | 50 - 66 | 99 - 108 | ESLTGGAFDI (SEQ ID NO: 3117) |
| 1081A04 | 2005 | 130 - 237 | 153 - 163 | 179 - 185 | 218 - 226 | 1 - 114 | 26 - 35 | 50 - 66 | 99 - 103 | DTTDY (SEQ ID NO: 2203) |
| 1081A06 | 2006 | 130 - 237 | 151 - 161 | 177 - 183 | 216 - 226 | 1 - 114 | 26 - 35 | 50 - 66 | 99 - 103 | DTTDY (SEQ ID NO: 2203) |
| 1081A08 | 2007 | 130 - 240 | 152 - 164 | 180 - 186 | 219 - 229 | 1 - 114 | 26 - 35 | 50 - 66 | 99 - 103 | DTTDY (SEQ ID NO: 2203) |
| 1081A09 | 2008 | 134 - 241 | 155 - 165 | 181 - 187 | 220 - 230 | 1 - 118 | 26 - 35 | 50 - 66 | 99 - 107 | GAGSRYFDL (SEQ ID NO: 3118) |
| 1081A10 | 2009 | 133 - 243 | 155 - 168 | 184 - 190 | 223 - 232 | 1 - 117 | 26 - 35 | 50 - 66 | 99 - 106 | GGDRAFDI (SEQ ID NO: 3119) |

| | | | | | | | | | | |
|---|---|---|---|---|---|---|---|---|---|---|
| 1081B01 | 2010 | 130 - 236 | 151 - 161 | 177 - 183 | 216 - 225 | 1 - 114 | 26 - 35 | 50 - 66 | 99 - 103 | DTTDY (SEQ ID NO: 2203) |
| 1081B04 | 2011 | 134 - 244 | 156 - 169 | 185 - 191 | 224 - 233 | 1 - 118 | 26 - 35 | 50 - 66 | 99 - 107 | GNAWGAFDI (SEQ ID NO: 2211) |
| 1081B05 | 2012 | 133 - 243 | 155 - 168 | 184 - 190 | 223 - 232 | 1 - 117 | 26 - 35 | 50 - 66 | 99 - 106 | GGDRAFDI (SEQ ID NO: 3119) |
| 1081B06 | 2013 | 133 - 240 | 154 - 164 | 180 - 186 | 219 - 229 | 1 - 117 | 26 - 35 | 50 - 66 | 99 - 106 | VKRYYFDY (SEQ ID NO: 3179) |
| 1081B07 | 2014 | 136 - 243 | 157 - 167 | 183 - 189 | 222 - 232 | 1 - 120 | 26 - 35 | 50 - 66 | 99 - 109 | ELTGANDAFDI (SEQ ID NO: 3104) |
| 1081B08 | 2015 | 132 - 239 | 153 - 163 | 179 - 185 | 218 - 228 | 1 - 116 | 26 - 35 | 50 - 66 | 99 - 105 | RRYALDY (SEQ ID NO: 2920) |
| 1081B09 | 2016 | 130 - 240 | 152 - 164 | 180 - 186 | 219 - 229 | 1 - 114 | 26 - 35 | 50 - 66 | 99 - 103 | DTTDY (SEQ ID NO: 2203) |
| 1081B10 | 2017 | 130 - 237 | 153 - 163 | 179 - 185 | 218 - 226 | 1 - 114 | 26 - 35 | 50 - 66 | 99 - 103 | DTTDY (SEQ ID NO: 2203) |
| 1081B11 | 2018 | 132 - 239 | 153 - 163 | 179 - 185 | 218 - 228 | 1 - 116 | 26 - 35 | 50 - 66 | 99 - 105 | GFALYKD (SEQ ID NO: 3169) |
| 1081C07 | 2019 | 130 - 237 | 153 - 163 | 179 - 185 | 218 - 226 | 1 - 114 | 26 - 35 | 50 - 66 | 99 - 103 | DTTDY (SEQ ID NO: 2203) |
| 1081C08 | 2020 | 130 - 237 | 153 - 163 | 179 - 185 | 218 - 226 | 1 - 114 | 26 - 35 | 50 - 66 | 99 - 103 | DTTDY (SEQ ID NO: 2203) |
| 1081D04 | 2021 | 135 - 242 | 156 - 166 | 182 - 188 | 221 - 231 | 1 - 119 | 26 - 35 | 50 - 66 | 99 - 108 | EDLTGDAFDI (SEQ ID NO: 3103) |
| 1081D06 | 2022 | 132 - 239 | 153 - 163 | 179 - 185 | 218 - 228 | 1 - 116 | 26 - 35 | 50 - 66 | 99 - 105 | GDAYFDY (SEQ ID NO: 3147) |
| 1081D08 | 2023 | 132 - 239 | 153 - 163 | 179 - 185 | 218 - 228 | 1 - 116 | 26 - 35 | 50 - 66 | 99 - 105 | GDAYFDY (SEQ ID NO: 3147) |
| 1081D09 | 2024 | 130 - 238 | 152 - 162 | 178 - 184 | 217 - 227 | 1 - 114 | 26 - 35 | 50 - 66 | 99 - 103 | DTTDY (SEQ ID NO: 2203) |
| 1081D10 | 2025 | 130 - 240 | 152 - 164 | 180 - 186 | 219 - 229 | 1 - 114 | 26 - 35 | 50 - 66 | 99 - 103 | DTTDY (SEQ ID NO: 2203) |
| 1081D11 | 2026 | 134 - 244 | 156 - 169 | 185 - 191 | 224 - 233 | 1 - 118 | 26 - 35 | 50 - 66 | 99 - 107 | EGLLDAFDI (SEQ ID NO: 3200) |
| 1081D12 | 2027 | 130 - 237 | 153 - 163 | 179 - 185 | 218 - 226 | 1 - 114 | 26 - 35 | 50 - 66 | 99 - 103 | DTTDY (SEQ ID NO: 2203) |
| 1081E02 | 2028 | 130 - 237 | 153 - 163 | 179 - 185 | 218 - 226 | 1 - 114 | 26 - 35 | 50 - 66 | 99 - 103 | DTTDY (SEQ ID NO: 2203) |
| 1081E03 | 2029 | 130 - 240 | 152 - 164 | 180 - 186 | 219 - 229 | 1 - 114 | 26 - 35 | 50 - 66 | 99 - 103 | DTTDY (SEQ ID NO: 2203) |
| 1081E05 | 2030 | 130 - 240 | 152 - 164 | 180 - 186 | 219 - 229 | 1 - 114 | 26 - 35 | 50 - 66 | 99 - 103 | DTTDY (SEQ ID NO: 2203) |
| 1081E06 | 2031 | 134 - 241 | 155 - 165 | 181 - 187 | 220 - 230 | 1 - 118 | 26 - 35 | 50 - 66 | 99 - 107 | VGYGGKGDY (SEQ ID NO: 3137) |
| 1081E07 | 2032 | 134 - 241 | 155 - 165 | 181 - 187 | 220 - 230 | 1 - 118 | 26 - 35 | 50 - 66 | 99 - 107 | GAGSRYFDL (SEQ ID NO: 3118) |
| 1081E10 | 2033 | 142 - 249 | 163 - 173 | 189 - 195 | 228 - 238 | 1 - 126 | 26 - 35 | 50 - 66 | 99 - 115 | GLAPIVDGGMTNDAFDI (SEQ ID NO: 3184) |
| 1081F01 | 2034 | 130 - 239 | 152 - 164 | 180 - 186 | 219 - 228 | 1 - 114 | 26 - 35 | 50 - 66 | 99 - 103 | DTTDY (SEQ ID NO: 2203) |
| 1081F04 | 2035 | 132 - 239 | 153 - 163 | 179 - 185 | 218 - 228 | 1 - 116 | 26 - 35 | 50 - 66 | 99 - 105 | RLIRKAR (SEQ ID NO: 3170) |
| 1081F05 | 2036 | 130 - 237 | 151 - 161 | 177 - 183 | 216 - 226 | 1 - 114 | 26 - 35 | 50 - 66 | 99 - 103 | DTTDY (SEQ ID NO: 2203) |
| 1081F06 | 2037 | 134 - 244 | 156 - 169 | 185 - 191 | 224 - 233 | 1 - 118 | 26 - 35 | 50 - 66 | 99 - 107 | ERGNQAFDI (SEQ ID NO: 3156) |
| 1081F07 | 2038 | 132 - 239 | 153 - 163 | 179 - 185 | 218 - 228 | 1 - 116 | 26 - 35 | 50 - 66 | 99 - 105 | RRYALDY (SEQ ID NO: 2920) |
| 1081F11 | 2039 | 130 - 237 | 151 - 161 | 177 - 183 | 216 - 226 | 1 - 114 | 26 - 35 | 50 - 66 | 99 - 103 | DTTDY (SEQ ID NO: 2203) |
| 1081G01 | 2040 | 130 - 237 | 153 - 163 | 179 - 185 | 218 - 226 | 1 - 114 | 26 - 35 | 50 - 66 | 99 - 103 | DTTDY (SEQ ID NO: 2203) |
| 1081G04 | 2041 | 130 - 240 | 152 - 164 | 180 - 186 | 219 - 229 | 1 - 114 | 26 - 35 | 50 - 66 | 99 - 103 | DTTDY (SEQ ID NO: 2203) |
| 1081G06 | 2042 | 135 - 245 | 157 - 170 | 186 - 192 | 225 - 234 | 1 - 119 | 26 - 35 | 50 - 66 | 99 - 108 | SRSPYDAFDI (SEQ ID NO: 3097) |
| 1081G10 | 2043 | 130 - 237 | 153 - 163 | 179 - 185 | 218 - 226 | 1 - 114 | 26 - 35 | 50 - 66 | 99 - 103 | DTTDY (SEQ ID NO: 2203) |
| 1081H02 | 2044 | 130 - 240 | 152 - 164 | 180 - 186 | 219 - 229 | 1 - 114 | 26 - 35 | 50 - 66 | 99 - 103 | DTTDY (SEQ ID NO: 2203) |
| 1081H03 | 2045 | 130 - 240 | 152 - 164 | 180 - 186 | 219 - 229 | 1 - 114 | 26 - 35 | 50 - 66 | 99 - 103 | DTTDY (SEQ ID NO: 2203) |
| 1081H04 | 2046 | 135 - 242 | 156 - 166 | 182 - 188 | 221 - 231 | 1 - 119 | 26 - 35 | 50 - 66 | 99 - 108 | SNWGGDAFDI (SEQ ID NO: 3202) |
| 1081H06 | 2047 | 130 - 240 | 152 - 165 | 181 - 187 | 220 - 229 | 1 - 114 | 26 - 35 | 50 - 66 | 99 - 103 | LAFDI (SEQ ID NO: 3174) |
| 1081H08 | 2048 | 130 - 240 | 152 - 164 | 180 - 186 | 219 - 229 | 1 - 114 | 26 - 35 | 50 - 66 | 99 - 103 | DTTDY (SEQ ID NO: 2203) |
| 1082A02 | 2049 | 139 - 249 | 161 - 173 | 189 - 195 | 228 - 238 | 1 - 123 | 26 - 35 | 50 - 66 | 99 - 112 | PAASSRGPKDAFDI (SEQ ID NO: 3129) |
| 1082A04 | 2050 | 130 - 240 | 152 - 165 | 181 - 187 | 220 - 229 | 1 - 114 | 26 - 35 | 50 - 66 | 99 - 103 | LSGDS (SEQ ID NO: 3122) |
| 1082A08 | 2051 | 134 - 243 | 156 - 168 | 184 - 190 | 223 - 232 | 1 - 118 | 26 - 35 | 50 - 66 | 99 - 107 | EGVAAGEDY (SEQ ID NO: 3123) |

| | | | | | | | | | | |
|---|---|---|---|---|---|---|---|---|---|---|
| 1082A11 | 2052 | 130 - 240 | 152 - 165 | 181 - 187 | 220 - 229 | 1 - 114 | 26 - 35 | 50 - 66 | 99 - 103 | FVLDY (SEQ ID NO: 2210) |
| 1082B06 | 2053 | 131 - 238 | 154 - 164 | 180 - 186 | 219 - 227 | 1 - 115 | 26 - 35 | 50 - 66 | 99 - 104 | GNGKDV (SEQ ID NO: 3135) |
| 1082B09 | 2054 | 134 - 241 | 157 - 167 | 183 - 189 | 222 - 230 | 1 - 118 | 26 - 35 | 50 - 66 | 99 - 107 | EGVAAGEDY (SEQ ID NO: 3123) |
| 1082B12 | 2055 | 131 - 241 | 153 - 166 | 182 - 188 | 221 - 230 | 1 - 115 | 26 - 35 | 50 - 66 | 99 - 104 | DLDFDY (SEQ ID NO: 2208) |
| 1082C01 | 2056 | 136 - 243 | 157 - 167 | 183 - 189 | 222 - 232 | 1 - 120 | 26 - 35 | 50 - 66 | 99 - 109 | VNDIVVVDMDV (SEQ ID NO: 3143) |
| 1082C05 | 2057 | 136 - 243 | 157 - 167 | 183 - 189 | 222 - 232 | 1 - 120 | 26 - 35 | 50 - 66 | 99 - 109 | EKRGSRRVFDI (SEQ ID NO: 3093) |
| 1082C08 | 2058 | 137 - 244 | 158 - 168 | 184 - 190 | 223 - 233 | 1 - 121 | 26 - 35 | 50 - 66 | 99 - 110 | LSNRNDNLRLDY (SEQ ID NO: 3106) |
| 1082D02 | 2059 | 130 - 240 | 152 - 165 | 181 - 187 | 220 - 229 | 1 - 114 | 26 - 35 | 50 - 66 | 99 - 103 | FVLDY (SEQ ID NO: 2210) |
| 1082E05 | 2060 | 134 - 241 | 155 - 165 | 181 - 187 | 220 - 230 | 1 - 118 | 26 - 35 | 50 - 66 | 99 - 107 | TWATNTFDM (SEQ ID NO: 3152) |
| 1082E06 | 2061 | 130 - 240 | 152 - 165 | 181 - 187 | 220 - 229 | 1 - 114 | 26 - 35 | 50 - 66 | 99 - 103 | FDLDY (SEQ ID NO: 3167) |
| 1082E07 | 2062 | 139 - 246 | 162 - 172 | 188 - 194 | 227 - 235 | 1 - 123 | 26 - 35 | 50 - 66 | 99 - 112 | VEWEDIVVGSAFDI (SEQ ID NO: 3128) |
| 1082F11 | 2063 | 136 - 243 | 159 - 169 | 185 - 191 | 224 - 232 | 1 - 120 | 26 - 35 | 50 - 66 | 99 - 109 | GGDMTTVTTDY (SEQ ID NO: 3177) |
| 1082G07 | 2064 | 136 - 243 | 159 - 169 | 185 - 191 | 224 - 232 | 1 - 120 | 26 - 35 | 50 - 66 | 99 - 109 | ADYSNDYYMDV (SEQ ID NO: 3166) |
| 1082G10 | 2065 | 138 - 249 | 160 - 173 | 189 - 195 | 228 - 238 | 1 - 118 | 26 - 35 | 50 - 66 | 99 - 107 | EGVAAGEDY (SEQ ID NO: 3123) |
| 1082G11 | 2066 | 143 - 250 | 164 - 174 | 190 - 196 | 229 - 239 | 1 - 127 | 26 - 35 | 50 - 66 | 99 - 116 | GPIYYFDGSAYEGYYFDY (SEQ ID NO: 3222) |
| 1082H04 | 2067 | 132 - 238 | 153 - 163 | 179 - 185 | 218 - 227 | 1 - 116 | 26 - 35 | 50 - 65 | 98 - 105 | MNADAFEI (SEQ ID NO: 3223) |
| 1082H09 | 2068 | 139 - 246 | 160 - 170 | 186 - 192 | 225 - 235 | 1 - 123 | 26 - 35 | 50 - 66 | 99 - 112 | PAASSRGPKDAFDI (SEQ ID NO: 3129) |
| 1083A06 | 2069 | 137 - 244 | 159 - 169 | 185 - 191 | 224 - 233 | 1 - 120 | 26 - 35 | 50 - 66 | 99 - 109 | DSRPTNRAFHY (SEQ ID NO: 3110) |
| 1083A09 | 2070 | 138 - 248 | 160 - 172 | 188 - 194 | 227 - 237 | 1 - 121 | 26 - 35 | 50 - 68 | 101 - 110 | LHCTGGSCGF (SEQ ID NO: 3186) |
| 1083A11 | 2071 | 136 - 248 | 158 - 171 | 187 - 193 | 226 - 237 | 1 - 119 | 26 - 35 | 50 - 66 | 99 - 108 | VRDDSAGFDY (SEQ ID NO: 3173) |
| 1083B03 | 2072 | 139 - 247 | 161 - 171 | 187 - 193 | 226 - 236 | 1 - 121 | 26 - 35 | 50 - 66 | 99 - 110 | VLVRGQYRGMDL (SEQ ID NO: 3138) |
| 1083B05 | 2073 | 139 - 250 | 161 - 174 | 190 - 196 | 229 - 239 | 1 - 122 | 26 - 35 | 50 - 66 | 99 - 111 | VDYTDYEMGAFDL (SEQ ID NO: 3172) |
| 1083B06 | 2074 | 139 - 250 | 161 - 174 | 190 - 196 | 229 - 239 | 1 - 122 | 26 - 35 | 50 - 66 | 99 - 111 | DRIAAAGGDAFDI (SEQ ID NO: 3194) |
| 1083B10 | 2075 | 139 - 246 | 162 - 172 | 188 - 194 | 227 - 235 | 1 - 121 | 26 - 35 | 50 - 66 | 99 - 110 | DLYKNGYALFDS (SEQ ID NO: 3197) |
| 1083C01 | 2076 | 136 - 247 | 158 - 171 | 187 - 193 | 226 - 236 | 1 - 119 | 26 - 35 | 50 - 66 | 99 - 108 | DEYSSLYMDV (SEQ ID NO: 3201) |
| 1083C02 | 2077 | 136 - 246 | 158 - 171 | 187 - 193 | 226 - 235 | 1 - 119 | 26 - 35 | 50 - 66 | 99 - 108 | FGAGRLYDDY (SEQ ID NO: 3224) |
| 1083C07 | 2078 | 137 - 249 | 159 - 172 | 188 - 194 | 227 - 238 | 1 - 120 | 26 - 35 | 50 - 66 | 99 - 109 | DNGGGTIGFDY (SEQ ID NO: 2195) |
| 1083C12 | 2079 | 136 - 246 | 158 - 171 | 187 - 193 | 226 - 235 | 1 - 119 | 26 - 35 | 50 - 66 | 99 - 108 | DQGIETANDY (SEQ ID NO: 3207) |
| 1083D04 | 2080 | 146 - 256 | 168 - 181 | 197 - 203 | 236 - 245 | 1 - 129 | 26 - 35 | 50 - 66 | 99 - 118 | DILFDYDFWNFNEDASSLDT (SEQ ID NO: 3133) |
| 1083D07 | 2081 | 150 - 262 | 173 - 188 | 204 - 210 | 243 - 251 | 1 - 132 | 26 - 35 | 50 - 66 | 99 - 121 | DFQMVRGVFIANPPIYNYYGMDV (SEQ ID NO: 3154) |
| 1083D08 | 2082 | 143 - 254 | 165 - 178 | 194 - 200 | 233 - 243 | 1 - 126 | 26 - 35 | 50 - 66 | 99 - 115 | DADEGLVEAETTNWFDS (SEQ ID NO: 3126) |
| 1083D10 | 2083 | 147 - 258 | 169 - 181 | 197 - 203 | 236 - 247 | 1 - 130 | 26 - 37 | 52 - 69 | 102 - 119 | ATKSYDILTRMYYYHMDV (SEQ ID NO: 2748) |
| 1083D12 | 2084 | 134 - 242 | 156 - 166 | 182 - 188 | 221 - 231 | 1 - 116 | 26 - 35 | 50 - 65 | 99 - 105 | DRTRMDV (SEQ ID NO: 3182) |
| 1083E02 | 2085 | 139 - 249 | 161 - 173 | 189 - 195 | 228 - 238 | 1 - 122 | 26 - 35 | 50 - 66 | 99 - 111 | VGIKAAAVDNFEY (SEQ ID NO: 2197) |
| 1083E03 | 2086 | 136 - 248 | 158 - 171 | 187 - 193 | 226 - 237 | 1 - 119 | 26 - 35 | 50 - 66 | 99 - 108 | DEIYNDAFDY (SEQ ID NO: 3105) |
| 1083E04 | 2087 | 144 - 255 | 166 - 179 | 195 - 201 | 234 - 244 | 1 - 127 | 26 - 35 | 50 - 66 | 99 - 115 | DGDISDSPINNQNYAMDI (SEQ ID NO: 3101) |
| 1083E08 | 2088 | 140 - 248 | 162 - 172 | 188 - 194 | 227 - 237 | 1 - 122 | 26 - 35 | 50 - 66 | 99 - 111 | RGGTSENYSGMDV (SEQ ID NO: 3209) |
| 1083E12 | 2089 | 135 - 245 | 157 - 170 | 186 - 192 | 225 - 234 | 1 - 118 | 26 - 35 | 50 - 66 | 99 - 107 | DYPHNAFDI (SEQ ID NO: 3127) |
| 1083F02 | 2090 | 146 - 258 | 168 - 181 | 197 - 203 | 236 - 247 | 1 - 129 | 26 - 35 | 50 - 66 | 99 - 118 | DVRSDRFWSGGYFHYSGMDV (SEQ ID NO: 3131) |
| 1083F04 | 2091 | 138 - 248 | 160 - 172 | 188 - 194 | 227 - 237 | 1 - 121 | 26 - 35 | 50 - 66 | 99 - 110 | STLEVGATDFDY (SEQ ID NO: 3199) |
| 1083F06 | 2092 | 135 - 247 | 157 - 170 | 186 - 192 | 225 - 236 | 1 - 118 | 26 - 35 | 50 - 66 | 99 - 107 | SDDWGAYHI (SEQ ID NO: 3198) |
| 1083F08 | 2093 | 139 - 250 | 161 - 174 | 190 - 196 | 229 - 239 | 1 - 122 | 26 - 35 | 50 - 66 | 99 - 111 | ERGGRDGDYALDF (SEQ ID NO: 3148) |

| | | | | | | | | | | |
|---|---|---|---|---|---|---|---|---|---|---|
| 1083F11 | 2094 | 137 - 248 | 159 - 172 | 188 - 194 | 227 - 237 | 1 - 120 | 26 - 35 | 50 - 66 | 99 - 109 | ELVGAPGGFDP (SEQ ID NO: 3191) |
| 1083G04 | 2095 | 139 - 250 | 161 - 174 | 190 - 196 | 229 - 239 | 1 - 122 | 26 - 35 | 50 - 66 | 99 - 111 | VDYTDYEMGAFDL (SEQ ID NO: 3172) |
| 1083G05 | 2096 | 139 - 249 | 161 - 173 | 189 - 195 | 228 - 238 | 1 - 121 | 26 - 35 | 50 - 68 | 101 - 110 | SVAGRGNFDY (SEQ ID NO: 3208) |
| 1083G06 | 2097 | 139 - 250 | 161 - 174 | 190 - 196 | 229 - 239 | 1 - 122 | 26 - 35 | 50 - 66 | 99 - 111 | ERGGRDGDYALDF (SEQ ID NO: 3148) |
| 1083G08 | 2098 | 142 - 253 | 164 - 177 | 193 - 199 | 232 - 242 | 1 - 125 | 26 - 35 | 50 - 66 | 99 - 114 | EGGGDAYDVAPYYFDY (SEQ ID NO: 2284) |
| 1083G09 | 2099 | 132 - 242 | 154 - 166 | 182 - 188 | 221 - 231 | 1 - 114 | 26 - 35 | 50 - 66 | 99 - 103 | DPFDY (SEQ ID NO: 3134) |
| 1083G11 | 2100 | 141 - 252 | 163 - 176 | 192 - 198 | 231 - 241 | 1 - 124 | 26 - 35 | 50 - 66 | 99 - 113 | ALLGLPSDFSYYVDV (SEQ ID NO: 3159) |
| 1083H04 | 2101 | 142 - 253 | 164 - 177 | 193 - 199 | 232 - 242 | 1 - 125 | 26 - 35 | 50 - 66 | 99 - 114 | EGEGDGYNVAPYYFDY (SEQ ID NO: 3160) |
| 1083H05 | 2102 | 135 - 243 | 157 - 167 | 183 - 189 | 222 - 232 | 1 - 117 | 26 - 35 | 50 - 66 | 99 - 106 | TDYGGFDY (SEQ ID NO: 3092) |
| 1083H07 | 2103 | 139 - 247 | 161 - 171 | 187 - 193 | 226 - 236 | 1 - 121 | 26 - 35 | 50 - 66 | 99 - 110 | GGVGDSRGVFDP (SEQ ID NO: 3162) |
| 1084A03 | 2104 | 130 - 237 | 153 - 163 | 179 - 185 | 218 - 226 | 1 - 114 | 26 - 35 | 50 - 66 | 99 - 103 | DTTDY (SEQ ID NO: 2203) |
| 1084A08 | 2105 | 130 - 240 | 152 - 164 | 180 - 186 | 219 - 229 | 1 - 114 | 26 - 35 | 50 - 66 | 99 - 103 | DTTDY (SEQ ID NO: 2203) |
| 1084B08 | 2106 | 135 - 242 | 156 - 166 | 182 - 188 | 221 - 231 | 1 - 119 | 26 - 35 | 50 - 65 | 99 - 108 | ESLTGDAFDI (SEQ ID NO: 3116) |
| 1084C02 | 2107 | 136 - 243 | 157 - 167 | 183 - 189 | 222 - 232 | 1 - 120 | 26 - 35 | 50 - 66 | 99 - 109 | SPLHFSDAFDI (SEQ ID NO: 3120) |
| 1084D03 | 2108 | 130 - 240 | 152 - 164 | 180 - 186 | 219 - 229 | 1 - 114 | 26 - 35 | 50 - 66 | 99 - 103 | DTTDY (SEQ ID NO: 2203) |
| 1084D05 | 2109 | 133 - 243 | 155 - 168 | 184 - 198 | 223 - 232 | 1 - 117 | 26 - 35 | 50 - 66 | 99 - 106 | EVGGAFDI (SEQ ID NO: 3157) |
| 1084E01 | 2110 | 130 - 237 | 153 - 163 | 179 - 185 | 218 - 226 | 1 - 114 | 26 - 35 | 50 - 66 | 99 - 103 | DTTDY (SEQ ID NO: 2203) |
| 1084E06 | 2111 | 130 - 237 | 153 - 163 | 179 - 185 | 218 - 226 | 1 - 114 | 26 - 35 | 50 - 66 | 99 - 103 | DTTDY (SEQ ID NO: 2203) |
| 1084E10 | 2112 | 130 - 237 | 151 - 161 | 177 - 183 | 216 - 226 | 1 - 114 | 26 - 35 | 50 - 66 | 99 - 103 | DTTDY (SEQ ID NO: 2203) |
| 1084E12 | 2113 | 130 - 240 | 152 - 164 | 180 - 186 | 219 - 229 | 1 - 114 | 26 - 35 | 50 - 66 | 99 - 103 | DTTDY (SEQ ID NO: 2203) |
| 1084F04 | 2114 | 130 - 237 | 153 - 163 | 179 - 185 | 218 - 226 | 1 - 114 | 26 - 35 | 50 - 66 | 99 - 103 | DTTDY (SEQ ID NO: 2203) |
| 1084F07 | 2115 | 130 - 237 | 153 - 163 | 179 - 185 | 218 - 226 | 1 - 114 | 26 - 35 | 50 - 66 | 99 - 103 | DTTDY (SEQ ID NO: 2203) |
| 1084F12 | 2116 | 135 - 245 | 157 - 170 | 186 - 192 | 225 - 234 | 1 - 119 | 26 - 35 | 50 - 66 | 99 - 108 | ESLTGDAFDI (SEQ ID NO: 3116) |
| 1084G12 | 2117 | 130 - 240 | 152 - 164 | 180 - 186 | 219 - 229 | 1 - 114 | 26 - 35 | 50 - 66 | 99 - 103 | DTTDY (SEQ ID NO: 2203) |
| 1084H02 | 2118 | 130 - 237 | 153 - 163 | 179 - 185 | 218 - 226 | 1 - 114 | 26 - 35 | 50 - 66 | 99 - 103 | DTTDY (SEQ ID NO: 2203) |
| 1099B05 | 2119 | 146 - 256 | 168 - 180 | 196 - 202 | 235 - 245 | 1 - 129 | 26 - 35 | 50 - 66 | 99 - 118 | GAHYYDRSPSHLKSYWYFDL (SEQ ID NO: 3149) |
| 1099G09 | 2120 | 139 - 249 | 161 - 173 | 189 - 195 | 228 - 238 | 1 - 122 | 26 - 35 | 50 - 66 | 99 - 111 | VGIKAAAVDNFEY (SEQ ID NO: 2197) |
| 1099H01 | 2121 | 140 - 248 | 162 - 172 | 188 - 194 | 227 - 237 | 1 - 122 | 26 - 35 | 50 - 66 | 99 - 111 | LGRNYTSSWSLDY (SEQ ID NO: 3181) |
| 1099H06 | 2122 | 139 - 249 | 161 - 173 | 189 - 195 | 228 - 238 | 1 - 122 | 26 - 35 | 50 - 66 | 99 - 111 | VGIKAAAVDNFEY (SEQ ID NO: 2197) |
| 1099H08 | 2123 | 145 - 255 | 167 - 179 | 195 - 201 | 234 - 244 | 1 - 128 | 26 - 35 | 50 - 66 | 99 - 117 | GGRYGYYYDGTGYYDAFDI (SEQ ID NO: 3226) |
| 1100A01 | 2124 | 137 - 247 | 159 - 172 | 188 - 194 | 227 - 236 | 1 - 120 | 26 - 35 | 50 - 66 | 99 - 109 | DNGGGTIGFDY (SEQ ID NO: 2195) |
| 1100A10 | 2125 | 141 - 251 | 163 - 175 | 191 - 197 | 230 - 240 | 1 - 124 | 26 - 35 | 50 - 66 | 99 - 113 | VRQQIADPPRSFFDP (SEQ ID NO: 3144) |
| 1100B03 | 2126 | 137 - 247 | 159 - 172 | 188 - 194 | 227 - 236 | 1 - 120 | 26 - 35 | 50 - 66 | 99 - 109 | DNGGGTIGFDY (SEQ ID NO: 2195) |
| 1100B04 | 2127 | 137 - 247 | 159 - 172 | 188 - 194 | 227 - 236 | 1 - 120 | 26 - 35 | 50 - 66 | 99 - 109 | DNGGGTIGFDY (SEQ ID NO: 2195) |
| 1100C03 | 2128 | 141 - 251 | 163 - 175 | 191 - 197 | 230 - 240 | 1 - 124 | 26 - 35 | 50 - 66 | 99 - 113 | VRQQIADPPRSFFDP (SEQ ID NO: 3144) |